(12) United States Patent
Zagursky et al.

(10) Patent No.: US 7,384,775 B2
(45) Date of Patent: Jun. 10, 2008

(54) STREPTOCOCCUS PNEUMONIAE OPEN READING FRAMES ENCODING POLYPEPTIDE ANTIGENS AND USES THEREOF

(75) Inventors: Robert John Zagursky, Victor, NY (US); Amy Wadhams Masi, Caledonia, NY (US); Bruce Arthur Green, New City, NY (US); Deb Narayan Chakravarti, Claremont, CA (US); David Parrish Russell, Canandaigua, NY (US); Joseph Lawrence Wooters, Brighton, MA (US)

(73) Assignee: Wyeth, Madison, NJ (US)

( * ) Notice: Subject to any disclaimer, the term of this patent is extended or adjusted under 35 U.S.C. 154(b) by 0 days.

(21) Appl. No.: 10/474,776

(22) PCT Filed: Apr. 12, 2002

(86) PCT No.: PCT/US02/11524

§ 371 (c)(1),
(2), (4) Date: Jan. 5, 2004

(87) PCT Pub. No.: WO02/083855

PCT Pub. Date: Oct. 24, 2002

(65) Prior Publication Data

US 2004/0110181 A1 Jun. 10, 2004

Related U.S. Application Data

(60) Provisional application No. 60/283,948, filed on Apr. 16, 2001, provisional application No. 60/284,443, filed on Apr. 18, 2001.

(51) Int. Cl.
*C12N 1/20* (2006.01)
*C12N 15/09* (2006.01)
*C07H 21/04* (2006.01)
*A61K 39/09* (2006.01)

(52) U.S. Cl. .................. 435/252.3; 435/69.1; 435/69.3; 435/320.1; 435/325; 536/23.7; 536/24.32; 424/234.1; 424/244.1

(58) Field of Classification Search .............. 435/69.1, 435/252.3, 320.1, 325, 69.3; 536/23.7, 24.32; 424/244.1, 234.1
See application file for complete search history.

(56) References Cited

U.S. PATENT DOCUMENTS

| | | | |
|---|---|---|---|
| 6,420,135 B1 * | 7/2002 | Kunsch et al. ............. | 435/69.1 |
| 6,573,082 B1 | 6/2003 | Choi et al. | |
| 6,800,744 B1 * | 10/2004 | Doucette-Stamm et al. .......................... | 536/23.1 |
| 6,887,663 B1 | 5/2005 | Choi et al. | |
| 2001/0053519 A1 * | 12/2001 | Fodor et al. ................ | 435/6 |

FOREIGN PATENT DOCUMENTS

| | | |
|---|---|---|
| WO | WO 98/18931 | 5/1998 |
| WO | WO 98/23631 A1 | 6/1998 |
| WO | WO 00/15769 A1 | 3/2000 |
| WO | WO 00/17644 A1 | 3/2000 |
| WO | WO 00/58475 A2 | 10/2000 |
| WO | WO 00/65026 | 11/2000 |
| WO | WO 01/14421 A1 | 3/2001 |
| WO | WO 01/40472 A2 | 6/2001 |
| WO | WO 01/81380 A2 | 11/2001 |
| WO | WO 02/053761 A2 | 7/2002 |
| WO | WO 02/077021 A2 | 10/2002 |
| WO | WO 02/079241 A2 | 10/2002 |
| WO | WO 077021 | 10/2002 |
| WO | WO 03/054007 A2 | 7/2003 |

OTHER PUBLICATIONS

Clinical and Diagnostic Laboratory Immunology, Jan. 2005, pp. 19-27, vol. 12, No. 1.*
Int Microbiol. Sep. 2004; 7(3): 163-71.*
Infect Immun. Dec. 1994;62(12):5384-96.*
Mol. Microbiol. 1991, 5(7): 1755 67.*
Molecular and Cellular Biology, 8(3): 1247 1252, 1988.*
The Journal of Cell Biology, 111:2129 2138, 1990.*
"Peptide Hormones", edited by Parsons, J.A., University Park Press, Jun. 1976, pp. 1-7.*

(Continued)

*Primary Examiner*—Shanon Foley
*Assistant Examiner*—Padma Baskar
(74) *Attorney, Agent, or Firm*—Royal N. Ronning, Jr.

(57) ABSTRACT

The present invention relates to newly identified open reading frames comprised within the genomic nucleotide sequence of *Streptococcus pneumoniae*, wherein the open reading frames encode polypeptides that are surface localized on *Streptococcus pneumoniae*. Thus, the invention relates to *Streptococcus pneumoniae* open reading frames that encode polypeptide antigens, polypeptides, preferably antigenic polypeptides, encoded by the *Streptococcus pneumoniae* open reading frames, vectors comprising open reading frame sequences and cells or animals transformed with these vectors. The invention relates also to methods of detecting these nucleic acids or polypeptides and kits for diagnosing *Streptococcus pneumoniae* infection. The invention finally relates to pharmaceutical compositions, in particular immunogenic compositions, for the prevention and/or treatment of bacterial infection, in particular infections with *Streptococcus pneumoniae*. In particular embodiments, the immunogenic compositions are used for the treatment or prevention of systemic diseases which are induced or exacerbated by *Streptococcus pneumoniae*. In other embodiments, the immunogenic compositions are used for the treatment or prevention of non-systemic diseases, particularly of the otitis media, which are induced or exacerbated by *Streptococcus pneumoniae*.

37 Claims, No Drawings

OTHER PUBLICATIONS

Journal of Molecular Biology, vol. 244, pp. 332 350 (1994).*
Journal of Leukocyte Biology, vol. 61, No. 5, pp. 545 550 (1997.*
BioEssays, vol. 18, No. 12, pp. 973 981,1996.*
Gerhold et al. [BioEssays, vol. 18, No. 12, pp. 973-981(1996)]; Wells et al. [Journal of Leukocyte Biology, vol. 61, No. 5, pp. 545-550 (1997)]; Russell et al. [Journal of Molecular Biology, vol. 244, pp. 332-350 (1994)].*
Rudinger et al, in "Peptide Hormones", edited by Parsons, J.A., University Park Press, Jun. 1976.*
Burgess et al., The Journal of Cell Biology, 111:2129-2138, 1990.*
Lazar et al., Molecular and Cellular Biology, 8(3): 1247-1252, 1988.*
Jobling et al. (Mol. Microbiol. 1991, 5(7): 1755-67.*
Geneseq [Online] Oct. 23, 1998, "*Streptococcus pneumoniae* genome fragment SEQ ID No. 214." retrieved from EBI accession No. GSN: AAV52347, Data base accession No. AAV52347 (the whole document).
Zhou Lixin et al., "Characterization of IS1167, a new insertion sequence in *Streptococcus pneumoniae*" Plasmid, vol. 33, No. 2, 1995, pp. 127-138, XP002278433, ISSN: 0147-619X.
Lange, R. et al., "Domain organization and molecular characterization of 13 two-component systems identified by genome sequencing of *Streptococcus pneumoniae*" Gene, Elsevier, Amsterdam, NL, vol. 237, No. 1, Sep. 3, 1999, pp. 223-234. XP004183515.
Wizemann, T. M. et al., "Use of a whole genome approach to identify vacine molecules affording protection against *Streptococcus pneumoniae* infection" Infection and Immunity, American Society for Microbiology, Washington, U.S., vol. 69, No. 3, Mar. 2001, pp. 1593-1598, XP002263818, ISSN: 0019-9567.
Adamou J. et al., "Identification and Characterizaion of a Novel Family in Pneumococcal Proteins That are Protective against Sepsis." Infection and Immunity, American Society for Microbiology, Washington, U.S., vol. 69, No. 2, Feb. 2001, pp. 949-958, XP002282664, ISSN: 0019-9567.
Fischer-Romero Carmen et al., "Development and evaluation of a broad-range PCR-ELISA assay with *Borrelia burgdorferi* and *Streptococcus pneumoniae* as model organisms for reactive arthritis and bacterial meningitis" Journal of Microbiological Methods, vol. 40, No. 1, Mar. 200, pp. 79-88. XP002396765.
Rimini, Rebecaa et al., "Global analysis of transcription kinetics during competence development in *Streptococcus pneumoniae* using high-density DNA arrays" Molecular Microbiology, vol. 36, No. 6, Jun. 2000, pp. 1279-1292. XP002396766.
Tettelin H. et al., "Complete genome sequence of a virulent isolate of *Streptococcus pneumoniae*" Science, American Association For the Advancement of Science, US, vol. 293, No. 5529, Jul. 20, 2001, pp. 498-506. XP002263816.
Hoskins, J. et al., "Genome of the Bacterium *Streptcoccus pneumoniae* Strain R6" Journal of Bacteriology, Washington, DC, US, vol. 183, No. 19, Oct. 2001, pp. 5709-5717. XP002231307.
Geneseq [Online] Oct. 3, 2002, "*Streptococcus pneumoniae* type 4 strain coding region #1060 Seq ID No. 2119." retrieved from EBI accession No. GSN: ABX06943, Database accession No. ABX06943 (the whole document).
Genseq [Online] Oct. 3, 2002, "*Streptococcus pneumoniae* type 4 strain coding region #1231 Seq ID No. 2461." retrieved from EBI accession No. GSN: ABX06943, Database accession No. GSN: ABX06943.
Geneseq [Online] Oct. 3, 2002, "*Streptococcus pneumoniae* type 4 strain coding region #1744 Seq ID No. 3487." retrieved from EBI accession No. GSN: ABX07456, Database accession No. ABX07456.
Geneseq [Online] Oct. 3, 2002, "*Streptococcus pneumoniae* type 4 strain coding region #1060 Seq ID No. 2120." retrieved from EBI accession No. GSP: ABU01484, Database accession No. ABU01484.
Geneseq [Online] Oct. 3, 2002, "*Streptococcus pneumoniae* type 4 strain coding region #1231 Seq ID No. 2462." retrieved from EBI accession No. GSP: ABU01484, Database accession No. ABU01484.
Geneseq [Online] Oct. 3, 2002, "*Streptococcus pneumoniae* type 4 strain coding region #1744 Seq ID No. 3488." retrieved from EBI accession No. GSP: ABU02167, Database accession No. ABU02167.

* cited by examiner

STREPTOCOCCUS PNEUMONIAE OPEN READING FRAMES ENCODING POLYPEPTIDE ANTIGENS AND USES THEREOF

This application claims priority from provisional application Ser. No. 60/283,948, filed on Apr. 16, 2001, the entire disclosure of which is hereby incorporated by reference and provisional application Ser. No. 60/284,443, filed Apr. 18, 2001, the entire disclosure of which is hereby incorporated by reference.

FIELD OF THE INVENTION

The invention relates to *Streptococcus pneumoniae* genomic sequence and polynucleotide sequences encoding polypeptides of *Streptococcus pneumoniae*. More particularly, the invention relates to newly identified polynucleotide open reading frames comprised within the genomic nucleotide sequence of *Streptococcus pneumoniae*, wherein the open reading frames encode *Streptococcus pneumoniae* polypeptides, preferably polypeptides that are surface localized, secreted, membrane associated or exposed on *Streptococcus pneumoniae*.

BACKGROUND OF THE INVENTION

*Streptococcus pneumoniae* infections are a major cause of human diseases such as otitis media, bacteremia, meningitis, septic arthritis and fatal pneumonia worldwide (Butler et al, 1999; James and Thomas, 2000). Over the past 10-20 years, *Streptococcus pneumoniae* has developed resistance to most antibiotics used for its treatment. In fact, it is common for *Streptococcus pneumoniae* to become resistant to more than one class of antibiotic, e.g., β-lactams, macrolides, lincosamides, trimethoprim-sulfamethoxazole, tetracyclines (Tauber, 2000), meaning *Streptococcus pneumoniae* treatment is becoming more difficult.

Thus, the rapid emergence of multi-drug resistant pneumococcal strains throughout the world has led to increased emphasis on prevention of pneumococcal infections by immunization (Goldstein and Garau, 1997). The currently available 23-valent pneumococcal capsular polysaccharide vaccine, is not effective in children of less than 2 years of age or in immunocompromised patients, two of the major populations at risk from pneumococcal infection (Douglas et al., 1983). A 7-valent pneumococcal polysaccharide-protein conjugate vaccine, recently licensed in the United States, was shown to be highly effective in infants and children against systemic pneumococcal disease caused by the vaccine serotypes and against cross-reactive capsular serotypes (Shinefield and Black, 2000). The seven capsular types cover greater than 80% of the invasive disease isolates in children in the United States, but only 57-60% of disease isolates in other areas of the world (Hausdorff et al, 2000). There is therefore an immediate need for a cost-effective vaccine to cover most or all of the disease causing serotypes of pneumococci. While this can be achieved by adding conjugates covering additional serotypes, efforts continue to find non-capsular vaccine antigens that are conserved among all pneumococcal serotypes and effective against pneumococcal disease.

Protein antigens of *Streptococcus pneumoniae* have been evaluated for protective efficacy in animal models of pneumococcal infection. Some of the most commonly studied candidate antigens include the PspA proteins, PsaA lipoprotein, and the CbpA protein. Numerous studies have shown that PspA protein is a virulence factor (Crain et al., 1990; McDaniel et al., 1984) but it is antigenically variable among pneumococcal strains. A recent study has indicated that some antigenically conserved regions of a recombinant PspA variant may elicit cross-reactive antibodies in human adults (Nabors et al., 2000). PsaA, a 37 kD lipoprotein with similarity to other gram-positive adhesins, is involved in $Mn^+$ transport in pneumococci (Sampson et al., 1994; Dintilhac et al., 1997) and has also been shown to be protective in mouse models of systemic disease (Talkington et al., 1996). The surface exposed choline binding protein CbpA is antigenically conserved and protective in mouse models of pneumococcal disease (Rosenow et al., 1997). Since nasopharyngeal colonization is a prerequisite for otic disease, intranasal immunization of mice with pneumococcal proteins and appropriate mucosal adjuvants has been used to enhance the mucosal antibody response and thus, the effectiveness of candidate antigens (Yamamoto et al., 1998; Briles et al., 2000).

While the PspA protein, PsaA lipoprotein and the CbpA protein antigens appear promising, it is possible that no one protein antigen will be effective against all *Streptococcus pneumoniae* serotypes. Laboratories therefore continue to search for additional candidates that are antigenically conserved and elicit antibodies that reduce colonization (important for otitis media), are protective against systemic disease, or both. Thus, there is an immediate need for a cost-effective vaccine to cover most or all of the disease causing serotypes of *Streptococcus pneumoniae* and methods of diagnosing *Streptococcus pneumoniae* infection. A better understanding of the genetic and molecular levels of *Streptococcus pneumoniae* infection will provide the basis for further development of preventative treatments, therapeutic treatments, new diagnostics and vaccine strategies which are specific for *Streptococcus pneumoniae*.

SUMMARY OF THE INVENTION

The present invention broadly relates to *Streptococcus pneumoniae* genomic sequence. More particularly, the invention relates to newly identified polynucleotide open reading frames comprised within the genomic nucleotide sequence of *Streptococcus pneumoniae*, wherein the open reading frames encode polypeptides that are surface localized, membrane associated, secreted, or exposed on *Streptococcus pneumoniae*.

Thus, in certain aspects, the invention relates to *Streptococcus pneumoniae* open reading frames that encode *Streptococcus pneumoniae* polypeptides. In preferred embodiments, these *Streptococcus pneumoniae* polypeptides are antigenic polypeptides. As defined hereinafter, a *Streptococcus pneumoniae* antigenic polypeptide, antigen or immunogen, is a *Streptococcus pneumoniae* polypeptide that is immunoreactive with an antibody or is a *Streptococcus pneumoniae* polypeptide that elicits an immune response. In other embodiments, the invention relates to the polynucleotides encoding these antigenic polypeptides. In other aspects, the invention relates to vectors comprising open reading frame sequences and cells or animals transformed, transfected or infected with these vectors. The invention relates also to methods of detecting these nucleic acids or polypeptides and kits for diagnosing *Streptococcus pneumoniae* infection. The invention further relates to pharmaceutical compositions, in particular immunogenic compositions, for the prevention and/or treatment of bacterial infection, in particular infections with *Streptococcus pneumoniae*. In a preferred embodiment, the immunogenic compositions are used for the treatment or prevention of systemic diseases that are induced or worsened by *Streptococcus pneumoniae*. In another preferred embodiment, the immunogenic compositions are used for the treatment or prevention of non-systemic diseases, particularly of the otitis media, which are induced or worsened by *Streptococcus pneumoniae*.

In particular embodiments, an isolated polynucleotide of the present invention is a polynucleotide comprising a nucleotide sequence having at least about 95% identity to a nucleotide sequence chosen from one of SEQ ID NO: 1 through SEQ ID NO: 215 or SEQ ID NO:431 through SEQ ID NO:591, a degenerate variant thereof, or a fragment thereof. As defined hereinafter, a "degenerate variant" is defined as a polynucleotide that differs from the nucleotide sequence shown in SEQ ID NO:1 through SEQ ID NO:215 and SEQ ID NO:431 through SEQ ID NO:591 (and fragments thereof due to degeneracy of the genetic code, but still encodes the same *Streptococcus pneumoniae* polypeptide (i.e., SEQ ID NO:216 through SEQ ID NO:430 and SEQ ID NO:592 through SEQ ID NO:752) as that encoded by the nucleotide sequence shown in SEQ ID NO:1 through SEQ ID NO:215 and SEQ ID NO:431 through SEQ ID NO:591.

In other embodiments, the polynucleotide is a complement to a nucleotide sequence chosen from one of SEQ ID NO: 1 through SEQ ID NO: 215 or SEQ ID NO:431 through SEQ ID NO:591, a degenerate variant thereof, or a fragment thereof. In yet other embodiments, the polynucleotide is selected from the group consisting of DNA, chromosomal DNA, cDNA and RNA and may further comprise heterologous nucleotides.

In another embodiment, the invention comprises an isolated polynucleotide that hybridizes to a nucleotide sequence chosen from one of SEQ ID NO: 1 through SEQ ID NO: 215 or SEQ ID NO:431 through SEQ ID NO:591, a complement thereof, a degenerate variant thereof, or a fragment thereof, under high stringency hybridization conditions. In yet other embodiments, the polynucleotide hybridizes under intermediate stringency hybridization conditions.

In a preferred embodiment, an isolated polynucleotide of a *Streptococcus pneumoniae* genomic sequence comprises a nucleotide sequence chosen from one of SEQ ID NO: 1 through SEQ ID NO: 215 or SEQ ID NO:431 through SEQ ID NO:591, a fragment thereof, or a degenerate variant thereof, and encodes a polypeptide, a biological equivalent thereof, or a fragment thereof, selected from the group consisting of a *Streptococcus pneumoniae* polypeptide having 0, 1 or 2 transmembrane domains, a *Streptococcus pneumoniae* polypeptide having 3 or more transmembrane domains, a *Streptococcus pneumoniae* polypeptide having an outer membrane domain or a periplasmic domain, a *Streptococcus pneumoniae* polypeptide having an inner membrane domain, a *Streptococcus pneumoniae* polypeptide identified by Blastp analysis, a *Streptococcus pneumoniae* polypeptide identified by Pfam analysis, a *Streptococcus pneumoniae* lipoprotein, a *Streptococcus pneumoniae* polypeptide having a LPXTG motif, wherein the polypeptide is covalently attached to the peptidoglycan layer, a *Streptococcus pneumoniae* polypeptide having a peptidoglycan binding motif, wherein the polypeptide is associated with the peptidoglycan layer, a *Streptococcus pneumoniae* polypeptide having a signal sequence and a C-terminal Tyrosine or Phenylalanine amino acid, a *Streptococcus pneumoniae* polypeptide having a tripeptide RGD sequence, a *Streptococcus pneumoniae* polypeptide identified by proteomics as surface exposed and a *Streptococcus pneumoniae* polypeptide identified by proteomics as membrane associated.

In other embodiments, the isolated polynucleotide is a complement to a *Streptococcus pneumoniae* genomic sequence comprising a nucleotide sequence chosen from one of SEQ ID NO: 1 through SEQ ID NO: 215 or SEQ ID NO:431 through SEQ ID NO:591, a fragment thereof, or a degenerate variant thereof, and encodes a polypeptide, a biological equivalent thereof, or a fragment thereof, selected from the group consisting of a *Streptococcus pneumoniae* polypeptide having 0, 1 or 2 transmembrane domains, a *Streptococcus pneumoniae* polypeptide having 3 or more transmembrane domains, a *Streptococcus pneumoniae* polypeptide having an outer membrane domain or a periplasmic domain, a *Streptococcus pneumoniae* polypeptide having an inner membrane domain, a *Streptococcus pneumoniae* polypeptide identified by Blastp analysis, a *Streptococcus pneumoniae* polypeptide identified by Pfam analysis, a *Streptococcus pneumoniae* lipoprotein, a *Streptococcus pneumoniae* polypeptide having a LPXTG motif, wherein the polypeptide is covalently attached to the peptidoglycan layer, a *Streptococcus pneumoniae* polypeptide having a peptidoglycan binding motif, wherein the polypeptide is associated with the peptidoglycan layer, a *Streptococcus pneumoniae* polypeptide having a signal sequence and a C-terminal Tyrosine or Phenylalanine amino acid, a *Streptococcus pneumoniae* polypeptide having a tripeptide RGD sequence, a *Streptococcus pneumoniae* polypeptide identified by proteomics as surface exposed and a *Streptococcus pneumoniae* polypeptide identified by proteomics as membrane associated. In certain embodiments, the polynucleotide is selected from the group consisting of DNA, chromosomal DNA, cDNA and RNA and may further comprise heterologous nucleotides. In still other embodiments, the polynucleotide encodes a fusion polypeptide.

In a preferred embodiment, a polynucleotide encoding a polypeptide having 0, 1 or 2 transmembrane domains comprises a nucleotide sequence chosen from one of SEQ ID NO: 1, SEQ ID NO: 3, SEQ ID NO: 4, SEQ ID NO: 7, SEQ ID NO: 8, SEQ ID NO: 9, SEQ ID NO: 11, SEQ ID NO: 13, SEQ ID NO: 16, SEQ ID NO: 17, SEQ ID NO: 18, SEQ ID NO: 19, SEQ ID NO: 22, SEQ ID NO: 23, SEQ ID NO: 24, SEQ ID NO: 25, SEQ ID NO: 28, SEQ ID NO: 29, SEQ ID NO: 32, SEQ ID NO: 34, SEQ ID NO: 36, SEQ ID NO: 39, SEQ ID NO: 41, SEQ ID NO: 42, SEQ ID NO: 45, SEQ ID NO: 47, SEQ ID NO: 49, SEQ ID NO: 50, SEQ ID NO: 51, SEQ ID NO: 53, SEQ ID NO: 55, SEQ ID NO: 57, SEQ ID NO: 58, SEQ ID NO: 60, SEQ ID NO: 61, SEQ ID NO: 62, SEQ ID NO: 63, SEQ ID NO: 64, SEQ ID NO: 66, SEQ ID NO: 67, SEQ ID NO: 68, SEQ ID NO: 69, SEQ ID NO: 70, SEQ ID NO: 72, SEQ ID NO: 73, SEQ ID NO: 74, SEQ ID NO: 78, SEQ ID NO: 79, SEQ ID NO: 81, SEQ ID NO: 83, SEQ ID NO: 85, SEQ ID NO: 86, SEQ ID NO: 89, SEQ ID NO: 91, SEQ ID NO: 92, SEQ ID NO: 95, SEQ ID NO: 96, SEQ ID NO: 97, SEQ ID NO: 100, SEQ ID NO: 104, SEQ ID NO: 105, SEQ ID NO: 106, SEQ ID NO: 109, SEQ ID NO: 110, SEQ ID NO: 111, SEQ ID NO: 113, SEQ ID NO: 116, SEQ ID NO: 121, SEQ ID NO: 122, SEQ ID NO: 123, SEQ ID NO: 125, SEQ ID NO: 126, SEQ ID NO: 127, SEQ ID NO: 128, SEQ ID NO: 131, SEQ ID NO: 132, SEQ ID NO: 134, SEQ ID NO: 136, SEQ ID NO: 137, SEQ ID NO: 138, SEQ ID NO: 141, SEQ ID NO: 142, SEQ ID NO: 143, SEQ ID NO: 144, SEQ ID NO: 147, SEQ ID NO: 148, SEQ ID NO: 149, SEQ ID NO: 150, SEQ ID NO: 155, SEQ ID NO: 156, SEQ ID NO: 158, SEQ ID NO: 161, SEQ ID NO: 162, SEQ ID NO: 165, SEQ ID NO: 170, SEQ ID NO: 171, SEQ ID NO: 172, SEQ ID NO: 174, SEQ ID NO: 176, SEQ ID NO: 179, SEQ ID NO: 183, SEQ ID NO: 185, SEQ ID NO: 187, SEQ ID NO: 192, SEQ ID NO: 195, SEQ ID NO: 196, SEQ ID NO: 197, SEQ ID NO: 199, SEQ ID NO: 200, SEQ ID NO: 201, SEQ ID NO: 202, SEQ ID NO: 204, SEQ ID NO: 205, SEQ ID NO: 207, SEQ ID NO: 209 and SEQ ID NO: 210.

In another preferred embodiment, a polynucleotide encoding a polypeptide having 3 or more transmembrane domains comprises a nucleotide sequence chosen from one of SEQ ID NO: 2, SEQ ID NO: 5, SEQ ID NO: 6, SEQ ID NO: 10, SEQ ID NO: 12, SEQ ID NO: 14, SEQ ID NO: 15, SEQ ID NO: 20, SEQ ID NO: 21, SEQ ID NO: 26, SEQ ID NO: 27, SEQ ID NO: 30, SEQ ID NO: 31, SEQ ID NO: 33, SEQ ID NO: 35, SEQ ID NO: 37, SEQ ID NO: 38, SEQ ID NO: 40, SEQ ID NO: 43, SEQ ID NO: 44, SEQ ID NO: 46, SEQ ID NO: 48, SEQ ID NO: 52, SEQ ID NO: 54, SEQ ID NO: 56, SEQ ID NO: 59, SEQ ID NO: 65, SEQ ID NO: 71, SEQ ID NO: 75, SEQ ID NO: 76, SEQ ID NO: 77, SEQ ID NO: 80, SEQ ID NO: 82, SEQ ID NO: 84, SEQ ID NO: 87, SEQ ID NO: 88, SEQ ID NO: 90, SEQ ID NO: 93, SEQ ID NO: 94, SEQ ID NO: 98, SEQ ID NO: 99, SEQ ID NO: 101, SEQ ID NO: 102, SEQ ID NO: 103, SEQ ID NO: 107, SEQ ID NO: 108, SEQ ID NO: 112, SEQ ID NO: 114, SEQ ID NO: 115, SEQ ID NO: 117, SEQ ID NO: 118, SEQ ID NO: 119, SEQ ID NO: 120, SEQ ID NO: 124, SEQ ID NO: 129, SEQ ID NO: 130, SEQ ID NO: 133, SEQ ID NO: 135, SEQ ID NO: 139, SEQ ID NO: 140, SEQ ID NO: 145, SEQ ID NO: 146, SEQ ID NO: 151, SEQ ID NO: 152, SEQ ID NO: 153, SEQ ID NO: 154, SEQ ID NO: 157, SEQ ID NO: 159, SEQ ID NO: 160, SEQ ID NO: 163, SEQ ID NO: 164, SEQ ID NO: 166, SEQ ID NO: 167, SEQ ID NO: 168, SEQ ID NO: 169, SEQ ID NO: 173, SEQ ID NO: 175, SEQ ID NO: 177, SEQ ID NO: 178, SEQ ID NO: 180, SEQ ID NO: 181, SEQ ID NO: 182, SEQ ID NO: 184, SEQ ID NO: 186, SEQ ID NO: 188, SEQ ID NO: 189, SEQ ID NO: 190, SEQ ID NO: 191, SEQ ID NO: 193, SEQ ID NO: 194, SEQ ID NO: 198, SEQ ID NO: 203, SEQ ID NO: 206, SEQ ID NO: 208, SEQ ID NO: 211, SEQ ID NO: 212, SEQ ID NO: 213, SEQ ID NO: 214 and SEQ ID NO: 215.

In other preferred embodiments, a polynucleotide encoding a polypeptide having an outer membrane domain or a periplasmic domain comprises a nucleotide sequence chosen from one of SEQ ID NO: 3, SEQ ID NO: 8, SEQ ID NO: 9, SEQ ID NO: 23, SEQ ID NO: 39, SEQ ID NO: 50, SEQ ID NO: 62, SEQ ID NO: 67, SEQ ID NO: 78, SEQ ID NO: 85, SEQ ID NO: 125, SEQ ID NO: 134, SEQ ID NO: 147, SEQ ID NO: 165, SEQ ID NO: 172 and SEQ ID NO: 179.

In other preferred embodiments, a polynucleotide encoding a polypeptide having an inner membrane domain comprises a nucleotide sequence chosen from one of SEQ ID NO: 2, SEQ ID NO: 5, SEQ ID NO: 6, SEQ ID NO: 7, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 19, SEQ ID NO: 20, SEQ ID NO: 21, SEQ ID NO: 22, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 40, SEQ ID NO: 43, SEQ ID NO: 44, SEQ ID NO: 46, SEQ ID NO: 47, SEQ ID NO: 48, SEQ ID NO: 51, SEQ ID NO: 52, SEQ ID NO: 53, SEQ ID NO: 54, SEQ ID NO: 56, SEQ ID NO: 59, SEQ ID NO: 60, SEQ ID NO: 61, SEQ ID NO: 65, SEQ ID NO: 68, SEQ ID NO: 69, SEQ ID NO: 70, SEQ ID NO: 71, SEQ ID NO: 73, SEQ ID NO: 75, SEQ ID NO: 76, SEQ ID NO: 77, SEQ ID NO: 79, SEQ ID NO: 80, SEQ ID NO: 81, SEQ ID NO: 82, SEQ ID NO: 83, SEQ ID NO: 84, SEQ ID NO: 86 SEQ ID NO: 87, SEQ ID NO: 88, SEQ ID NO: 90, SEQ ID NO: 91, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 105, SEQ ID NO: 106, SEQ ID NO: 107, SEQ ID NO: 108, SEQ ID NO: 109, SEQ ID NO: 112, SEQ ID NO: 113, SEQ ID NO: 114, SEQ ID NO: 115, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 135, SEQ ID NO: 136, SEQ ID NO: 139, SEQ ID NO: 140, SEQ ID NO: 141, SEQ ID NO: 142, SEQ ID NO: 144, SEQ ID NO: 145, SEQ ID NO: 146, SEQ ID NO: 148, SEQ ID NO: 150, SEQ ID NO: 151, SEQ ID NO: 152, SEQ ID NO: 153, SEQ ID NO: 154, SEQ ID NO: 156, SEQ ID NO: 157, SEQ ID NO: 158, SEQ ID NO: 159, SEQ ID NO: 160, SEQ ID NO: 162, SEQ ID NO: 163, SEQ ID NO: 164, SEQ ID NO: 166, SEQ ID NO: 167, SEQ ID NO: 168, SEQ ID NO: 169, SEQ ID NO: 170, SEQ ID NO: 173, SEQ ID NO: 175, SEQ ID NO: 176, SEQ ID NO: 177, SEQ ID NO: 178, SEQ ID NO: 180, SEQ ID NO: 181, SEQ ID NO: 182, SEQ ID NO: 184, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 198, SEQ ID NO: 200, SEQ ID NO: 203, SEQ ID NO: 206, SEQ ID NO: 208, SEQ ID NO: 209, SEQ ID NO: 211, SEQ ID NO: 212, SEQ ID NO: 213, SEQ ID NO: 214 and SEQ ID NO: 215.

In yet another preferred embodiment, a polynucleotide encoding a polypeptide identified by Blastp analysis comprises a nucleotide sequence chosen from one of SEQ ID NO: 1, SEQ ID NO: 2, SEQ ID NO: 7, SEQ ID NO: 10, SEQ ID NO: 12, SEQ ID NO: 16, SEQ ID NO: 20, SEQ ID NO: 24, SEQ ID NO: 27, SEQ ID NO: 30, SEQ ID NO: 31, SEQ ID NO: 32, SEQ ID NO: 33, SEQ ID NO: 34, SEQ ID NO: 35, SEQ ID NO: 38, SEQ ID NO: 40, SEQ ID NO: 42, SEQ ID NO: 43, SEQ ID NO: 44, SEQ ID NO: 48, SEQ ID NO: 51, SEQ ID NO: 53, SEQ ID NO: 59, SEQ ID NO: 60, SEQ ID NO: 61, SEQ ID NO: 65, SEQ ID NO: 67, SEQ ID NO: 68, SEQ ID NO: 69, SEQ ID NO: 70, SEQ ID NO: 71, SEQ ID NO: 75, SEQ ID NO: 76, SEQ ID NO: 77, SEQ ID NO: 78, SEQ ID NO: 79, SEQ ID NO: 80, SEQ ID NO: 87, SEQ ID NO: 88, SEQ ID NO: 90, SEQ ID NO: 94, SEQ ID NO: 95, SEQ ID NO: 96, SEQ ID NO: 98, SEQ ID NO: 100, SEQ ID NO: 103, SEQ ID NO: 105, SEQ ID NO: 107, SEQ ID NO: 108, SEQ ID NO: 109, SEQ ID NO: 112, SEQ ID NO: 113, SEQ ID NO: 115, SEQ ID NO: 117, SEQ ID NO: 118, SEQ ID NO: 122, SEQ ID NO: 123, SEQ ID NO: 124, SEQ ID NO: 127, SEQ ID NO: 129, SEQ ID NO: 131, SEQ ID NO: 132, SEQ ID NO: 133, SEQ ID NO: 134, SEQ ID NO: 135, SEQ ID NO: 136, SEQ ID NO: 138, SEQ ID NO: 139, SEQ ID NO: 141, SEQ ID NO: 144, SEQ ID NO: 146, SEQ ID NO: 147, SEQ ID NO: 151, SEQ ID NO: 152, SEQ ID NO: 154, SEQ ID NO: 155, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 165, SEQ ID NO: 166, SEQ ID NO: 167, SEQ ID NO: 169, SEQ ID NO: 172, SEQ ID NO: 173, SEQ ID NO: 176, SEQ ID NO: 177, SEQ ID NO: 178, SEQ ID NO: 180, SEQ ID NO: 181, SEQ ID NO: 182, SEQ ID NO: 184, SEQ ID NO: 185, SEQ ID NO: 186, SEQ ID NO: 188, SEQ ID NO: 189, SEQ ID NO: 191, SEQ ID NO: 193, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 204, SEQ ID NO: 205, SEQ ID NO: 206, SEQ ID NO: 207, SEQ ID NO: 208, SEQ ID NO: 210, SEQ ID NO: 212, SEQ ID NO: 213 and SEQ ID NO: 214.

In still further preferred embodiments, a polynucleotide encoding a polypeptide identified by Pfam analysis comprises a nucleotide sequence chosen from one of SEQ ID NO: 4, SEQ ID NO: 18, SEQ ID NO: 19, SEQ ID NO: 41, SEQ ID NO: 45, SEQ ID NO: 55, SEQ ID NO: 57, SEQ ID NO: 58, SEQ ID NO: 63, SEQ ID NO: 64, SEQ ID NO: 66, SEQ ID NO: 72, SEQ ID NO: 74, SEQ ID NO: 89, SEQ ID NO: 92, SEQ ID NO: 104, SEQ ID NO: 111, SEQ ID NO: 116, SEQ ID NO: 119, SEQ ID NO: 128, SEQ ID NO: 137, SEQ ID NO: 142, SEQ ID NO: 143, SEQ ID NO: 149, SEQ ID NO: 151, SEQ ID NO: 152, SEQ ID NO: 153, SEQ ID NO: 157, SEQ ID NO: 159, SEQ ID NO: 160, SEQ ID NO: 162, SEQ ID NO: 163, SEQ ID NO: 164, SEQ ID NO: 165, SEQ ID NO: 166, SEQ ID NO: 169, SEQ ID NO: 171, SEQ ID NO: 174, SEQ ID NO: 176, SEQ ID NO: 180, SEQ ID NO: 182, SEQ ID NO: 183, SEQ ID NO: 184, SEQ ID NO: 186, SEQ ID NO: 188, SEQ ID NO 189, SEQ ID NO: 195, SEQ ID NO: 198, SEQ ID NO 199, SEQ ID NO: 205, SEQ ID NO: 212 and SEQ ID NO: 213.

In another preferred embodiment, a polynucleotide encoding a lipoprotein comprises a nucleotide sequence chosen from one of SEQ ID NO: 3, SEQ ID NO: 8, SEQ ID NO: 9, SEQ ID NO: 13, SEQ ID NO: 21, SEQ ID NO: 26, SEQ ID NO: 34, SEQ ID NO: 62, SEQ ID NO: 67, SEQ ID NO: 85, SEQ ID NO: 134, SEQ ID NO: 147, SEQ ID NO: 150, SEQ ID NO: 168, SEQ ID NO: 170 and SEQ ID NO: 173.

In other preferred embodiments, a polynucleotide encoding a polypeptide having a LPXTG motif and is covalently attached to the peptidoglycan layer comprises a nucleotide sequence chosen from one of SEQ ID NO: 13, SEQ ID NO: 21, SEQ ID NO: 34 and SEQ ID NO: 170; or a polynucleotide encoding a polypeptide having a peptidoglycan binding motif and associated with the peptidoglycan layer comprises a nucleotide sequence chosen from one of SEQ ID NO: 25, SEQ ID NO: 49 and SEQ ID NO: 110.

In another preferred embodiment, a polynucleotide encoding a polypeptide having a signal sequence and a C-terminal Tyrosine or Phenylalanine amino acid comprises a nucleotide sequence chosen from one of SEQ ID NO:11, SEQ ID NO:39, SEQ ID NO:73, SEQ ID NO:97, SEQ ID NO:106, SEQ ID NO: 125 and SEQ ID NO:187.

In yet another preferred embodiment, a polynucleotide encoding a polypeptide having a tripeptide RGD sequence that potentially is involved in cell attachment comprises a nucleotide sequence chosen from one of SEQ ID NO:1, SEQ ID NO:21, SEQ ID NO:66 and SEQ ID NO:67.

In another preferred embodiment, a polynucleotide encoding a polypeptide identified by proteomics as surface exposed comprises a nucleotide sequence chosen from one of SEQ ID NO:14, SEQ ID NO:16, SEQ ID NO:17, SEQ ID NO:46, SEQ ID NO:64, SEQ ID NO:66, SEQ ID NO:67, SEQ ID NO:69, SEQ ID NO:71, SEQ ID NO:74, SEQ ID NO:91, SEQ ID NO:103, SEQ ID NO:116, SEQ ID NO:128, SEQ ID NO:131, SEQ ID NO:136, SEQ ID NO:151, SEQ ID NO:156, SEQ ID NO:159, SEQ ID NO:162, SEQ ID NO:164, SEQ ID NO:172, SEQ ID NO:176, SEQ ID NO:178, SEQ ID NO:179, SEQ ID NO:180, SEQ ID NO:182 and SEQ ID NO:205.

In still another embodiment, a polynucleotide encoding a polypeptide identified by proteomics as membrane associated comprises a nucleotide sequence chosen from one of SEQ ID NO:431 through SEQ ID NO:591.

In certain aspects, the invention relates to *Streptococcus pneumoniae* polypeptides. More particularly, the invention relates to *Streptococcus pneumoniae* polypeptides, more preferably antigenic polypeptides, encoded by *Streptococcus pneumoniae* polynucleotide open reading frames. Thus, in certain embodiments, an isolated polypeptide is encoded by a polynucleotide comprising a nucleotide sequence having at least about 95% identity to a nucleotide sequence chosen from one of SEQ ID NO: 1 through SEQ ID NO: 215 or SEQ ID NO: 431 through SEQ ID NO: 591, a degenerate variant thereof, or a fragment thereof. In a preferred embodiment, the isolated polypeptide encoded by one of the above polynucleotides comprises an amino acid sequence having at least about 95% identity to an amino acid sequence chosen from one of SEQ ID NO: 216 through SEQ ID NO: 430 or SEQ ID NO: 592 through SEQ ID NO: 752, a biological equivalent thereof, or a fragment thereof. In other embodiments, the polypeptide is a fusion polypeptide. In a preferred embodiment, the polypeptide immunoreacts with seropositive serum of an individual infected with *Streptococcus pneumoniae*.

In preferred embodiments, the isolated polypeptide encoded by a polynucleotide comprising a nucleotide sequence having at least about 95% identity to a nucleotide sequence chosen from one of SEQ ID NO: 1 through SEQ ID NO: 215 or SEQ ID NO: 431 through SEQ ID NO: 591, a degenerate variant thereof, or a fragment thereof, is further defined as a *Streptococcus pneumoniae* polypeptide having 0, 1 or 2 transmembrane domains, a *Streptococcus pneumoniae* polypeptide having 3 or more transmembrane domains, a *Streptococcus pneumoniae* polypeptide having an outer membrane domain or a periplasmic domain, a *Streptococcus pneumoniae* polypeptide having an inner membrane domain, a *Streptococcus pneumoniae* polypeptide identified by Blastp analysis, a *Streptococcus pneumoniae* polypeptide identified by Pfam analysis, a *Streptococcus pneumoniae* lipoprotein, a *Streptococcus pneumoniae* polypeptide having a LPXTG motif, wherein the polypeptide is covalently attached to the peptidoglycan layer, a *Streptococcus pneumoniae* polypeptide having a peptidoglycan binding motif, wherein the polypeptide is associated with the peptidoglycan layer, a *Streptococcus pneumoniae* polypeptide having a signal sequence and a C-terminal Tyrosine or Phenylalanine amino acid, a *Streptococcus pneumoniae* polypeptide having a tripeptide RGD sequence, a *Streptococcus pneumoniae* polypeptide identified by proteomics as surface exposed or a *Streptococcus pneumoniae* polypeptide identified by proteomics as membrane associated, where each of these groups has the set of ORFs identified above as within SEQ ID NO: 1 through SEQ ID NO: 215 or SEQ ID NO: 431 through SEQ ID NO: 591.

In a particularly preferred embodiment, an isolated polypeptide comprises an amino acid sequence having at least about 95% identity to an amino acid sequence chosen from one of SEQ ID NO: 216 through SEQ ID NO: 430 or SEQ ID NO: 592 through SEQ ID NO: 752, a biological equivalent thereof, or a fragment thereof. In another embodiment, the polypeptide is a fusion polypeptide. In a particularly preferred embodiment, the polypeptide immunoreacts with seropositive serum of an individual infected with *Streptococcus pneumoniae*. In yet other preferred embodiments, the polypeptide is further defined as a *Streptococcus pneumoniae* polypeptide having 0, 1 or 2 transmembrane domains, a *Streptococcus pneumoniae* polypeptide having 3 or more transmembrane domains, a *Streptococcus pneumoniae* polypeptide having an outer membrane domain or a periplasmic domain, a *Streptococcus pneumoniae* polypeptide having an inner membrane domain, a *Streptococcus pneumoniae* polypeptide identified by Blastp analysis, a *Streptococcus pneumoniae* polypeptide identified by Pfam analysis, a *Streptococcus pneumoniae* lipoprotein, a *Streptococcus pneumoniae* polypeptide having a LPXTG motif, wherein the polypeptide is covalently attached to the peptidoglycan layer, a *Streptococcus pneumoniae* polypeptide having a peptidoglycan binding motif, wherein the polypeptide is associated with the peptidoglycan layer, a *Streptococcus pneumoniae* polypeptide having a signal sequence and a C-terminal Tyrosine or Phenylalanine amino acid, a *Streptococcus pneumoniae* polypeptide having a tripeptide RGD sequence, a *Streptococcus pneumoniae* polypeptide identified by proteomics as surface exposed or a *Streptococcus pneumoniae* polypeptide identified by proteomics as membrane associated.

In a preferred embodiment, a polypeptide having 0, 1 or 2 transmembrane domains comprises an amino acid sequence chosen from one of SEQ ID NO: 216, SEQ ID NO: 218, SEQ ID NO: 219, SEQ ID NO: 222, SEQ ID NO: 223, SEQ ID NO: 224, SEQ ID NO: 226, SEQ ID NO: 228, SEQ ID NO: 231, SEQ ID NO: 232, SEQ ID NO: 233, SEQ ID NO: 234, SEQ ID NO: 237, SEQ ID NO: 238, SEQ ID NO: 239, SEQ ID NO: 240, SEQ ID NO: 243, SEQ ID NO: 244, SEQ ID NO: 247, SEQ ID NO: 249, SEQ ID NO: 251, SEQ ID NO: 254, SEQ ID NO: 256, SEQ ID NO: 257, SEQ ID NO: 260, SEQ ID NO: 262, SEQ ID NO: 264, SEQ ID NO: 265, SEQ ID NO: 266, SEQ ID NO: 268, SEQ ID NO: 270, SEQ ID NO: 272, SEQ ID NO: 273, SEQ ID NO: 275, SEQ ID NO: 276, SEQ ID NO: 277, SEQ ID NO: 278, SEQ ID NO: 279, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 289, SEQ ID NO: 293, SEQ ID NO: 294, SEQ ID NO: 296, SEQ ID NO: 298, SEQ ID NO: 300, SEQ ID NO: 301, SEQ ID NO: 304, SEQ ID NO: 306, SEQ ID NO: 307, SEQ ID NO: 310, SEQ ID NO: 311, SEQ ID NO: 312, SEQ ID NO: 315, SEQ ID NO: 319, SEQ ID NO: 320, SEQ ID NO: 321, SEQ ID NO: 324, SEQ ID NO: 325, SEQ ID NO: 326, SEQ ID NO: 328, SEQ ID NO: 331, SEQ ID NO: 336, SEQ ID NO: 337, SEQ ID NO: 338, SEQ ID NO: 340, SEQ ID NO: 341, SEQ ID NO: 342, SEQ ID NO: 343, SEQ ID NO: 346, SEQ ID NO: 347, SEQ ID NO: 349, SEQ ID NO: 351, SEQ ID NO: 352, SEQ ID NO: 353, SEQ ID NO: 356, SEQ ID NO: 357, SEQ ID NO: 358, SEQ ID NO: 359, SEQ ID NO: 362, SEQ ID NO: 363, SEQ ID NO: 364, SEQ ID NO: 365, SEQ ID NO: 370, SEQ ID NO: 371, SEQ ID NO: 373, SEQ ID NO: 376, SEQ ID NO: 377, SEQ ID NO: 380, SEQ ID NO: 385, SEQ ID NO: 386, SEQ ID NO: 387, SEQ ID NO: 389, SEQ ID NO: 391, SEQ ID NO: 394, SEQ ID NO: 398, SEQ ID NO: 400, SEQ ID NO: 402, SEQ ID NO: 407, SEQ ID NO: 410, SEQ ID NO: 411, SEQ ID NO: 412, SEQ ID NO: 414, SEQ ID NO: 415, SEQ ID NO: 416, SEQ ID NO: 417, SEQ ID NO: 419, SEQ ID NO: 420, SEQ ID NO: 422, SEQ ID NO: 424, SEQ ID NO: 425, a biological equivalent thereof, or a fragment thereof.

In another preferred embodiment, a polypeptide having 3 or more transmembrane domains comprises an amino acid sequence chosen from on of SEQ ID NO: 217, SEQ ID NO: 220, SEQ ID NO: 221, SEQ ID NO: 225, SEQ ID NO: 227, SEQ ID NO: 229, SEQ ID NO: 230, SEQ ID NO: 235, SEQ ID NO: 236, SEQ ID NO: 241, SEQ ID NO: 242, SEQ ID NO: 245, SEQ ID NO: 246, SEQ ID NO: 248, SEQ ID NO: 250, SEQ ID NO: 252, SEQ ID NO: 253, SEQ ID NO: 255, SEQ ID NO: 258, SEQ ID NO: 259, SEQ ID NO: 261, SEQ ID NO: 263, SEQ ID NO: 267, SEQ ID NO: 269, SEQ ID NO: 271, SEQ ID NO: 274, SEQ ID NO: 280, SEQ ID NO: 286, SEQ ID NO: 290, SEQ ID NO: 291, SEQ ID NO: 292, SEQ ID NO: 295, SEQ ID NO: 297, SEQ ID NO: 299, SEQ ID NO: 302, SEQ ID NO: 303, SEQ ID NO: 305, SEQ ID NO: 308, SEQ ID NO: 309, SEQ ID NO: 313, SEQ ID NO: 314, SEQ ID NO: 316, SEQ ID NO: 317, SEQ ID NO: 318, SEQ ID NO: 322, SEQ ID NO: 323, SEQ ID NO: 327, SEQ ID NO: 329, SEQ ID NO: 330, SEQ ID NO: 332, SEQ ID NO: 333, SEQ ID NO: 334, SEQ ID NO: 335, SEQ ID NO: 339, SEQ ID NO: 344, SEQ ID NO: 345, SEQ ID NO: 348, SEQ ID NO: 350, SEQ ID NO: 354, SEQ ID NO: 355, SEQ ID NO: 360, SEQ ID NO: 361, SEQ ID NO: 366, SEQ ID NO: 367, SEQ ID NO: 368, SEQ ID NO: 369, SEQ ID NO: 372, SEQ ID NO: 374, SEQ ID NO: 375, SEQ ID NO: 378, SEQ ID NO: 379, SEQ ID NO: 381, SEQ ID NO: 382, SEQ ID NO: 383, SEQ ID NO: 384, SEQ ID NO: 388, SEQ ID NO: 390, SEQ ID NO: 392, SEQ ID NO: 393, SEQ ID NO: 395, SEQ ID NO: 396, SEQ ID NO: 397, SEQ ID NO: 399, SEQ ID NO: 401, SEQ ID NO: 403, SEQ ID NO: 404, SEQ ID NO: 405, SEQ ID NO: 406, SEQ ID NO: 408, SEQ ID NO: 409, SEQ ID NO: 413, SEQ ID NO: 418, SEQ ID NO: 421, SEQ ID NO: 423, SEQ ID NO: 426, SEQ ID NO: 427, SEQ ID NO: 428, SEQ ID NO: 429, SEQ ID NO: 430, a biological equivalent thereof, or a fragment thereof.

In yet other preferred embodiments, a polypeptide having an outer membrane domain or a periplasmic domain comprises an amino acid sequence chosen from one of SEQ ID NO: 218, SEQ ID NO: 223, SEQ ID NO: 224, SEQ ID NO: 238, SEQ ID NO: 254, SEQ ID NO: 265, SEQ ID NO: 277, SEQ ID NO: 282, SEQ ID NO: 293, SEQ ID NO: 300, SEQ ID NO: 340, SEQ ID NO: 349, SEQ ID NO: 362, SEQ ID NO: 380, SEQ ID NO: 387, SEQ ID NO: 394, a biological equivalent thereof, or a fragment thereof.

In yet other preferred embodiments, a polynucleotide encoding a polypeptide having an inner membrane domain comprises an amino acid sequence chosen from one of SEQ ID NO: 217, SEQ ID NO: 220, SEQ ID NO: 221, SEQ ID NO: 222, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 234, SEQ ID NO: 235, SEQ ID NO: 236, SEQ ID NO: 237, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 255, SEQ ID NO: 258, SEQ ID NO: 259, SEQ ID NO: 261, SEQ ID NO: 262, SEQ ID NO: 263, SEQ ID NO: 266, SEQ ID NO: 267, SEQ ID NO: 268, SEQ ID NO: 269, SEQ ID NO: 271, SEQ ID NO: 274, SEQ ID NO: 275, SEQ ID NO: 276, SEQ ID NO: 280, SEQ ID NO: 283, SEQ ID NO: 284, SEQ ID NO: 285, SEQ ID NO: 286, SEQ ID NO: 288, SEQ ID NO: 290, SEQ ID NO: 291, SEQ ID NO: 292, SEQ ID NO: 294, SEQ ID NO: 295, SEQ ID NO: 296, SEQ ID NO: 297, SEQ ID NO: 298, SEQ ID NO: 299, SEQ ID NO: 301 SEQ ID NO: 302, SEQ ID NO: 303, SEQ ID NO: 305, SEQ ID NO: 306, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 320, SEQ ID NO: 321, SEQ ID NO: 322, SEQ ID NO: 323, SEQ ID NO: 324, SEQ ID NO: 327, SEQ ID NO: 328, SEQ ID NO: 329, SEQ ID NO: 330, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 341, SEQ ID NO: 342, SEQ ID NO: 343, SEQ ID NO: 344, SEQ ID NO: 345, SEQ ID NO: 346, SEQ ID NO: 347, SEQ ID NO: 348, SEQ ID NO: 350, SEQ ID NO: 351, SEQ ID NO: 354, SEQ ID NO: 355, SEQ ID NO: 356, SEQ ID NO: 357, SEQ ID NO: 359, SEQ ID NO: 360, SEQ ID NO: 361, SEQ ID NO: 362, SEQ ID NO: 365, SEQ ID NO: 366, SEQ ID NO: 367, SEQ ID NO: 368, SEQ ID NO: 369, SEQ ID NO: 371, SEQ ID NO: 372, SEQ ID NO: 373, SEQ ID NO: 374, SEQ ID NO: 375, SEQ ID NO: 377, SEQ ID NO: 378, SEQ ID NO: 379, SEQ ID NO: 381, SEQ ID NO: 382, SEQ ID NO: 383, SEQ ID NO: 384, SEQ ID NO: 385, SEQ ID NO: 388, SEQ ID NO: 390, SEQ ID NO: 391, SEQ ID NO: 392, SEQ ID NO: 393, SEQ ID NO: 395, SEQ ID NO: 396, SEQ ID NO: 397, SEQ ID NO: 399, SEQ ID NO: 401, SEQ ID NO: 402, SEQ ID NO: 403, SEQ ID NO: 404, SEQ ID NO: 405, SEQ ID NO: 406, SEQ ID NO: 407, SEQ ID NO: 408, SEQ ID NO: 409, SEQ ID NO: 410, SEQ ID NO: 413, SEQ ID NO: 415, SEQ ID NO: 418, SEQ ID NO: 421, SEQ ID NO: 423, SEQ ID NO: 424, SEQ ID NO: 426, SEQ ID NO: 427, SEQ ID NO: 428, SEQ ID NO: 429, SEQ ID NO: 430, a biological equivalent thereof, or a fragment thereof.

In still another preferred embodiment, a polypeptide identified by Blastp analysis comprises an amino acid sequence chosen from one of SEQ ID NO: 216, SEQ ID NO: 217, SEQ ID NO: 222, SEQ ID NO: 225, SEQ ID NO: 227, SEQ ID NO: 231, SEQ ID NO: 235, SEQ ID NO: 239, SEQ ID NO: 242, SEQ ID NO: 245, SEQ ID NO: 246, SEQ ID NO: 247, SEQ ID NO: 248, SEQ ID NO: 249, SEQ ID NO: 250, SEQ ID NO: 253, SEQ ID NO: 255, SEQ ID NO: 257, SEQ ID NO: 258, SEQ ID NO: 259, SEQ ID NO: 263, SEQ ID NO: 266, SEQ ID NO: 268, SEQ ID NO: 269, SEQ ID NO: 275, SEQ ID NO: 276, SEQ ID NO: 280, SEQ ID NO: 282, SEQ ID NO: 283, SEQ ID NO: 284, SEQ ID NO: 285, SEQ ID NO: 286, SEQ ID NO: 290, SEQ ID NO: 291, SEQ ID NO: 292, SEQ ID NO: 293, SEQ ID NO: 294, SEQ ID NO: 295, SEQ ID NO: 302, SEQ ID NO: 303, SEQ ID NO: 305, SEQ ID NO: 309, SEQ ID NO: 310, SEQ ID NO: 311, SEQ ID NO: 313, SEQ ID NO: 315, SEQ ID NO: 318, SEQ ID NO: 320, SEQ ID NO: 322, SEQ ID NO: 323, SEQ ID NO: 324, SEQ ID NO: 327, SEQ ID NO: 328, SEQ ID NO: 330, SEQ ID NO: 332, SEQ ID NO: 333, SEQ ID NO: 337, SEQ ID NO: 338, SEQ ID NO: 339, SEQ ID NO: 342, SEQ ID NO: 344, SEQ ID NO: 346, SEQ ID NO: 347, SEQ ID NO: 348, SEQ ID NO: 349, SEQ ID NO: 350, SEQ ID NO: 351, SEQ ID NO: 353, SEQ ID NO: 354, SEQ ID NO: 356, SEQ ID NO: 359, SEQ ID NO: 361, SEQ ID NO: 362, SEQ ID NO: 366, SEQ ID NO: 367, SEQ ID NO: 369, SEQ ID NO: 370, SEQ ID NO: 372, SEQ ID NO: 373, SEQ ID NO: 374, SEQ ID NO: 375, SEQ ID NO: 376, SEQ ID NO: 377, SEQ ID NO: 378, SEQ ID NO: 380, SEQ ID NO: 381, SEQ ID NO: 382, SEQ ID NO: 384, SEQ ID NO: 387, SEQ ID NO: 388, SEQ ID NO: 391, SEQ ID NO: 392, SEQ ID NO: 393, SEQ ID NO: 395, SEQ ID NO: 396, SEQ ID NO: 397, SEQ ID NO: 399, SEQ ID NO: 400, SEQ ID NO: 401, SEQ ID NO: 403, SEQ ID NO: 404, SEQ ID NO: 406, SEQ ID NO: 408, SEQ ID NO: 411, SEQ ID NO: 412, SEQ ID NO: 413, SEQ ID NO: 414, SEQ ID NO: 415, SEQ ID NO: 416, SEQ ID NO: 417, SEQ ID NO: 419, SEQ ID NO: 420, SEQ ID NO: 421, SEQ ID NO: 422, SEQ ID NO: 423, SEQ ID NO: 425, SEQ ID NO: 427, SEQ ID NO: 428, SEQ ID NO: 429, a biological equivalent thereof, or a fragment thereof.

In other preferred embodiments, a polypeptide identified by Pfam analysis comprises an amino acid sequence chosen from one of SEQ ID NO: 219, SEQ ID NO: 233, SEQ ID NO: 234, SEQ ID NO: 255, SEQ ID NO: 260, SEQ ID NO: 270, SEQ ID NO: 272, SEQ ID NO: 273, SEQ ID NO: 278, SEQ ID NO: 279, SEQ ID NO: 281, SEQ ID NO: 287, SEQ ID NO: 289, SEQ ID NO: 304, SEQ ID NO: 307, SEQ ID NO: 319, SEQ ID NO: 326, SEQ ID NO: 331, SEQ ID NO: 334, SEQ ID NO: 343, SEQ ID NO: 352, SEQ ID NO: 357, SEQ ID NO: 358, SEQ ID NO: 364, SEQ ID NO: 366, SEQ ID NO: 367, SEQ ID NO: 368, SEQ ID NO: 372, SEQ ID NO: 374, SEQ ID NO: 375, SEQ ID NO: 377, SEQ ID NO: 378, SEQ ID NO: 379, SEQ ID NO: 380, SEQ ID NO: 381, SEQ ID NO: 384, SEQ ID NO: 386, SEQ ID NO: 389, SEQ ID NO: 391, SEQ ID NO: 395, SEQ ID NO: 397, SEQ ID NO: 398, SEQ ID NO: 399, SEQ ID NO: 401, SEQ ID NO: 403, SEQ ID NO 404, SEQ ID NO: 410, SEQ ID NO: 413, SEQ ID NO 414, SEQ ID NO: 420, SEQ ID NO: 427, SEQ ID NO: 428, a biological equivalent thereof, or a fragment thereof.

In one preferred embodiment, a polypeptide is a lipoprotein and comprises an amino acid sequence chosen from one of SEQ ID NO: 218, SEQ ID NO: 223, SEQ ID NO: 224, SEQ ID NO: 228, SEQ ID NO: 236, SEQ ID NO: 241, SEQ ID NO: 249, SEQ ID NO: 277, SEQ ID NO: 282, SEQ ID NO: 300, SEQ ID NO: 349, SEQ ID NO: 362, SEQ ID NO: 365, SEQ ID NO: 383, SEQ ID NO: 385, SEQ ID NO: 388, a biological equivalent thereof, or a fragment thereof.

In certain other preferred embodiments, a polypeptide having a LPXTG motif and covalently attached to the peptidoglycan layer, comprises an amino acid sequence chosen from one of SEQ ID NO: 228, SEQ ID NO: 236, SEQ ID NO: 249, SEQ, SEQ ID NO: 385, a biological equivalent thereof, or a fragment thereof; or a polypeptide having a peptidoglycan binding motif and associated with the peptidoglycan layer comprises an amino add sequence chosen from one of SEQ ID NO: 240, SEQ ID NO: 264, SEQ ID NO: 325, a biological equivalent thereof, or a fragment thereof.

In another preferred embodiment, a polypeptide having a signal sequence and a C-terminal Tyrosine or Phenylalanine amino acid comprises an amino acid sequence chosen from one of SEQ ID NO:226, SEQ ID NO:254, SEQ ID NO:289, SEQ ID NO:312, SEQ ID NO:321, SEQ ID NO: 340, SEQ ID NO:402, a biological equivalent thereof, or a fragment thereof.

In yet another preferred embodiment, a polypeptide having a tripeptide RGD sequence that potentially is involved in cell attachment comprises an amino acid sequence chosen from one of SEQ ID NO:216, SEQ ID NO:236, SEQ ID NO:281, SEQ ID NO:282, a biological equivalent thereof, or a fragment thereof.

In still another embodiment, a polypeptide identified by proteomics as surface exposed comprises an amino acid sequence chosen from one of SEQ ID NO: 229, SEQ ID NO: 231, SEQ ID NO: 232, SEQ ID NO: 261, SEQ ID NO: 279, SEQ ID NO: 281, SEQ ID NO: 282, SEQ ID NO: 284, SEQ ID NO: 286, SEQ ID NO: 289, SEQ ID NO: 306, SEQ ID NO: 318, SEQ ID NO: 331, SEQ ID NO: 343, SEQ ID NO: 346, SEQ ID NO: 351, SEQ ID NO: 366, SEQ ID NO: 371, SEQ ID NO: 374, SEQ ID NO: 377, SEQ ID NO: 379, SEQ ID NO: 387, SEQ ID NO: 391, SEQ ID NO: 393, SEQ ID NO: 394, SEQ ID NO: 395, SEQ ID NO: 397, SEQ ID NO: 420, a biological equivalent thereof, or a fragment thereof.

In yet another embodiment, a polypeptide identified by proteomics as membrane associated comprises an amino acid sequence chosen from one of SEQ ID NO: 592 through SEQ ID NO: 752, a biological equivalent thereof, or a fragment thereof.

In another aspect of the invention, the polypeptides are expressed and purified in a recombinant expression system. Thus, in certain embodiments, the invention provides a recombinant expression vector comprising a nucleotide sequence having at least about 95% identity to a nucleotide sequence chosen from one of SEQ ID NO: 1 through SEQ ID NO: 215 or SEQ ID NO: 431 through SEQ ID NO: 591, a degenerate variant thereof, or a fragment thereof. In certain other embodiments, the polynucleotide is selected from the group consisting of DNA, chromosomal DNA, cDNA, RNA and antisense RNA. In another embodiment, the polynucleotide comprised within the vector further comprises heterologous nucleotide sequences. In other embodiments, the polynucleotide is operatively linked to one or more gene expression regulatory elements. In yet other embodiments, the polynucleotide encodes a polypeptide comprising an amino acid sequence having at least about 95% identity to an amino acid sequence chosen from one of SEQ ID NO: 216 through SEQ ID NO: 430 or SEQ ID NO: 592 through SEQ ID NO: 752, a biological equivalent thereof, or a fragment thereof. In a preferred embodiment, the vector is a plasmid.

In another aspect of the invention, there is provided a genetically engineered host cell, transfected, transformed or infected with a recombinant expression vector comprising a nucleotide sequence having at least about 95% identity to a nucleotide sequence chosen from one of SEQ ID NO: 1 through SEQ ID NO: 215 or SEQ ID NO: 431 through SEQ ID NO: 591, a degenerate variant thereof, or a fragment thereof. In a preferred embodiment, the host cell is a bacterial cell. In a further embodiment, the polynucleotide is expressed under suitable conditions to produce the encoded polypeptide, a biological equivalent thereof, or a fragment thereof, which is then recovered.

In other embodiments, the present invention provides an antibody specific for a *Streptococcus pneumoniae* polynucleotide chosen from one of SEQ ID NO: 1 through SEQ ID NO: 215 or SEQ ID NO: 431 through SEQ ID NO: 591, a fragment thereof, a degenerate variant thereof, or an antibody specific for a *Streptococcus pneumoniae* polypeptide chosen from one of SEQ ID NO: 216 through SEQ ID NO: 430 or SEQ ID NO: 592 through SEQ ID NO: 752, a biological equivalent thereof, or a fragment thereof. In certain embodiments, the antibody is selected from the group consisting of monoclonal, polyclonal, chimeric, humanized and single chain. In a preferred embodiment, the antibody is monoclonal. In another preferred embodiment, the antibody is humanized.

The present invention further provides pharmaceutical compositions, in particular immunogenic compositions, for the prevention and/or treatment of bacterial infection. Thus, in one embodiment an immunogenic composition is provided comprising a polypeptide having an amino acid sequence chosen from one or more of SEQ ID NO: 216 through SEQ ID NO: 430 or SEQ ID NO: 592 through SEQ ID NO: 752, a biological equivalent thereof, or a fragment thereof. In certain embodiments, the composition further comprises a pharmaceutically acceptable carrier. In yet other embodiments, the immunogenic composition further comprises one or more adjuvants. In a preferred embodiment, the polypeptide of the immunogenic composition is further defined as a *Streptococcus pneumoniae* polypeptide having 0, 1 or 2 transmembrane domains, a *Streptococcus pneumoniae* polypeptide having 3 or more transmembrane domains, a *Streptococcus pneumoniae* polypeptide having an outer membrane domain or a periplasmic domain, a *Streptococcus pneumoniae* polypeptide having an inner membrane domain, a *Streptococcus pneumoniae* polypeptide identified by Blastp analysis, a *Streptococcus pneumoniae* polypeptide identified by Pfam analysis, a *Streptococcus pneumoniae* lipoprotein, a *Streptococcus pneumoniae* polypeptide having a LPXTG motif, wherein the polypeptide is covalently attached to the peptidoglycan layer, a *Streptococcus pneumoniae* polypeptide having a peptidoglycan binding motif, wherein the polypeptide is associated with the peptidoglycan layer, a *Streptococcus pneumoniae* polypeptide having a signal sequence and a C-terminal Tyrosine or Phenylalanine amino acid, a *Streptococcus pneumoniae* polypeptide having a tripeptide RGD sequence, a *Streptococcus pneumoniae* polypeptide identified by proteomics as surface exposed or a *Streptococcus pneumoniae* polypeptide identified by proteomics as membrane associated. In certain other embodiments, the immunogenic composition further comprises heterologous amino acids. In particular embodiments, the polypeptide is a fusion polypeptide.

In further embodiments, provided is an immunogenic composition comprising a polynucleotide having a nucleotide sequence chosen from one or more of SEQ ID NO: 1 through SEQ ID NO: 215 or SEQ ID NO: 431 through SEQ ID NO: 591, a degenerate variant thereof, or a fragment thereof and is comprised in an expression vector. In preferred embodiments, the vector is plasmid DNA. In another embodiment, the polynucleotide comprises heterologous nucleotides. In still other embodiments, the polynucleotide is operatively linked to one or more gene expression regulatory elements. In yet other embodiments, the polynucleotide directs the expression of a neutralizing epitope of *Streptococcus pneumoniae*. In preferred embodiments, the immunogenic composition further comprises one or more adjuvants.

Also provided is a pharmaceutical composition comprising a polypeptide and a pharmaceutically acceptable carrier, wherein the polypeptide comprises an amino acid chosen from one of SEQ ID NO: 216 through SEQ ID NO: 430 or SEQ ID NO: 592 through SEQ ID NO: 752, a biological equivalent thereof, or a fragment thereof. In preferred embodiments, the polypeptide is further defined as a *Streptococcus pneumoniae* polypeptide having 0, 1 or 2 transmembrane domains, a *Streptococcus pneumoniae* polypeptide having 3 or more transmembrane domains, a *Streptococcus pneumoniae* polypeptide having an outer membrane domain or a periplasmic domain, a *Streptococcus pneumoniae* polypeptide having an inner membrane domain, a *Streptococcus pneumoniae* polypeptide identified by Blastp analysis, a *Streptococcus pneumoniae* polypeptide identified by Pfam analysis, a *Streptococcus pneumoniae* lipoprotein, a *Streptococcus pneumoniae* polypeptide having a LPXTG motif, wherein the polypeptide is covalently attached to the peptidoglycan layer, a *Streptococcus pneumoniae* polypeptide having a peptidoglycan binding motif, wherein the polypeptide is associated with the peptidoglycan layer, a *Streptococcus pneumoniae* polypeptide having a signal sequence and a C-terminal Tyrosine or Phenylalanine amino acid, a *Streptococcus pneumoniae* polypeptide having a tripeptide RGD sequence, a *Streptococcus pneumoniae* polypeptide identified by proteomics as surface exposed or a *Streptococcus pneumoniae* polypeptide identified by proteomics as membrane associated. In certain embodiments, the polypeptide further comprises heterologous amino acids. In still other embodiments, the polypeptide is a fusion polypeptide.

In another embodiment, a method of immunizing against *Streptococcus pneumoniae* is provided comprising administering to a host an immunizing amount of an immunogenic composition comprising one or more polypeptides and a pharmaceutically acceptable carrier, wherein the polypeptide comprises an amino acid sequence chosen from one or more of SEQ ID NO: 216 through SEQ ID NO: 430 or SEQ ID NO: 592 through SEQ ID NO: 752, a biological equivalent thereof, or a fragment thereof. In certain embodiments, the polypeptide is a fusion polypeptide. In other embodiments, the method further comprises administering an adjuvant.

Other embodiments of the invention provide a DNA chip comprising an array of polynucleotides, wherein at least one of the polynucleotides comprise a nucleotide sequence chosen from one of SEQ ID NO: 1 through SEQ ID NO: 215 or SEQ ID NO: 431 through SEQ ID NO: 591, a complement thereof, a degenerate variant thereof, or a fragment thereof.

Also provided is a protein chip comprising an array of polypeptides, wherein at least one of the polypeptides comprises an amino acid sequence chosen from one of SEQ ID NO: 216 through SEQ ID NO: 430 or SEQ ID NO: 592 through SEQ ID NO: 752, a biological equivalent thereof, or a fragment thereof.

The invention further provides methods of detecting *Streptococcus pneumoniae* polynucleotides and polypeptides as well as kits for diagnosing *Streptococcus pneumoniae* infection.

Other embodiments provide a method for the detection and/or identification of *Streptococcus pneumoniae* in a biological sample comprising contacting the sample with an oligonucleotide probe of a polynucleotide comprising the nucleotide sequence chos n from one of SEQ ID NO: 1 through SEQ ID NO: 215 or SEQ ID NO: 431 through SEQ ID NO: 591, a degenerate variant thereof, or a fragment thereof, under conditions permitting hybridization and detecting the presence of hybridization complexes in the sample, wherein hybridization complexes indicate the presence of *Streptococcus pneumoniae* in the sample.

Still other embodiments provide a method for the detection and/or identification of *Streptococcus pneumoniae* in a biological sample comprising a nucleotide sequence chosen from one of SEQ ID NO: 1 through SEQ ID NO: 215 or SEQ ID NO: 431 through SEQ ID NO: 591, a degenerate variant thereof, or a fragment thereof, in the presence of nucleotides and a polymerase enzyme under conditions permitting primer extension and detecting the presence of primer extension products in the sample, wherein extension products indicate the presence of *Streptococcus pneumoniae* in the sample.

Further embodiments provide a method for the detection and/or identification of *Streptococcus pneumoniae* in a biological sample comprising contacting the sample with an antibody specific for a polypeptide comprising an amino acid sequence chosen from one of SEQ ID NO: 216 through SEQ ID NO: 430 or SEQ ID NO: 592 through SEQ ID NO: 752, a biological equivalent thereof, or a fragment thereof, under conditions permitting immune complex formation and detecting the presence of immune complexes in the sample, wherein immune complexes indicate the presence of *Streptococcus pneumoniae* in the sample.

In certain embodiments, provided is a method for the detection and/or identification of antibodies to *Streptococcus pneumoniae* in a biological sample comprising contacting the sample with a polypeptide comprising an amino acid sequence chosen from one of SEQ ID NO: 216 through SEQ ID NO: 430 or SEQ ID NO: 592 through SEQ ID NO: 752, a biological equivalent thereof, or a fragment thereof, under conditions permitting immune complex formation and detecting the presence of immune complexes in the sample, wherein immune complexes indicate the presence of *Streptococcus pneumoniae* in the sample.

Other embodiments of the invention provide a kit comprising a container containing an isolated polynucleotide comprising an nucleotide sequence chosen from one of SEQ ID NO: 1 through SEQ ID NO: 215 or SEQ ID NO: 431 through SEQ ID NO: 591, a degenerate variant thereof, or a fragment thereof. In a preferred embodiment, the polynucleotide is a primer or a probe, wherein when the polynucleotide is a primer, the kit further comprises a container containing a polymerase. In another embodiment, the kit further comprises a container containing dNTP.

Provided further is a kit comprising a container containing an antibody that immunospecifically binds to a polypeptide comprising the amino acid sequence chosen from one of SEQ ID NO: 216 through SEQ ID NO: 430 or SEQ ID NO: 592 through SEQ ID NO: 752, a biological equivalent thereof, or a fragment thereof.

Provided also is a kit comprising a container containing an antibody that immunospecifically binds to a fusion polypeptide comprising at least the amino acid sequence chosen from one of SEQ ID NO: 216 through SEQ ID NO: 430 or SEQ ID NO: 592 through SEQ ID NO: 752, a biological equivalent thereof, or a fragment thereof.

In a preferred embodiment of the invention, provided is a genetically engineered host cell, transfected, transformed or infected with a recombinant expression vector comprising a nucleotide sequence having at least about 95% identity to a nucleotide sequence chosen from one of SEQ ID NO: 1 through SEQ ID NO: 215 or SEQ ID NO: 431 through SEQ ID NO: 591, a degenerate variant thereof, or a fragment thereof under conditions suitable to produce one of the polypeptides of SEQ ID NO:216 through SEQ ID NO:430 or SEQ ID NO: 592 through SEQ ID NO: 752; and recovering the polypeptide.

Other features and advantages of the invention will be apparent from the following detailed description, from the preferred embodiments thereof, and from the claims.

DETAILED DESCRIPTION OF THE INVENTION

The invention described hereinafter addresses the need for *Streptococcus pneumoniae* immunogenic compositions that effectively prevent or treat most or all of the disease caused by serotypes of *Streptococcus pneumoniae*. The invention further addresses the need for methods of diagnosing *Streptococcus pneumoniae* infection. The present invention has identified novel *Streptococcus pneumoniae* open reading frames, hereinafter ORFs, which encode antigenic polypeptides. More particularly, the newly identified ORFs encode polypeptides that are secreted, exposed, membrane associated or surface localized on *Streptococcus pneumoniae*, and thus serve as potential antigenic polypeptides in immunogenic compositions. Thus, in certain embodiments, the invention comprises *Streptococcus pneumoniae* polynucleotide ORFs encoding surface localized, exposed, secreted or membrane associated polypeptide antigens. The present invention therefore comprises in other embodiments, these polypeptides, preferably antigenic polypeptides, encoded by the *Streptococcus pneumoniae* ORFs.

In other embodiments, the invention comprises vectors comprising ORF sequences and host cells or animals transformed, transfected or infected with these vectors. The invention also comprises transcriptional gene products of *Streptococcus pneumoniae* ORFs, such as, for example, mRNA, antisense RNA, antisense oligonucleotides and ribozyme molecules, which can be used to inhibit or control growth of the microorganism. The invention relates also to methods of detecting these nucleic acids or polypeptides and kits for diagnosing *Streptococcus pneumoniae* infection. The invention also relates to pharmaceutical compositions, in particular immunogenic compositions, for the prevention and/or treatment of bacterial infection, in particular infection caused by or exacerbated by *Streptococcus pneumoniae*. In particular embodiments, the immunogenic compositions are used for the treatment or prevention of systemic diseases which are induced or exacerbated by *Streptococcus pneumoniae*. In other embodiments, the immunogenic compositions are used for the treatment or prevention of non-systemic diseases, particularly of the otitis media, which are induced or exacerbated by *Streptococcus pneumoniae*.

A. Identifying ORFs Within the Genomic Sequence of *Streptococcus Pneumoniae*

The invention is directed in particular embodiments to the identification of polynucleotides, more particularly ORFs, that encode *Streptococcus pneumoniae* polypeptides. The availability of complete bacterial genome sequences has begun to play an important role in the identification of candidate antigens through genomics, transcriptional profiling, and proteomics, coupled with the information processing capabilities of bioinformatics (McAtee et al., 1998a; McAtee et al., 1998b; Pizza et al., 2000; Sonnenberg and Belisle, 1997; Weldingh et al., 1998; McAtee et at, 1998c). Currently, no more than approximately 60% of all ORFs within a bacterial genome have some match with a polypeptide whose function has been determined. This leaves approximately 40% of genomic ORFs uncharacterized. Thus, the inventors have analyzed the *Streptococcus pneumoniae* genome and utilized bioinformatic tools to identify novel ORFs encoding polypeptides of the present invention. In addition to genomic analysis, the inventors analyzed the *Streptococcus pneumoniae* membrane proteome component to identify novel and/or confirm ORFs encoding polypeptides of the present invention. As described below, the ORFs were analyzed for a variety of characteristics.

Specifically, an extensive genomic analysis was performed in silico of the *Streptococcus pneumoniae* type 4 genome from The Institute for Genomic Research (TIGR) using algorithms designed to identify genes that encode novel surface localized polypeptides or polypeptides with putative similarity to polypeptides of known interest in other organisms. Thus, a combined analysis of the *Streptococcus pneumoniae* genome, using a unique set of two ORF finder algorithms (i.e., GLIMMER, Salzberg et al., 1998 and inventors' assignee's own program), produced 3,799 ORFs. The most stringent of the ORF finders; Glimmer, produced 2,022 ORFs, while the assignee's ORF finder produced the most with 3,798 ORFs. There were 2,021 ORFs identified by the two algorithms. The difference in results between the different ORF finders is primarily due to the particular start codons used by each program; however, Glimmer also incorporates some evaluation for a Shine-Dalgarno box and an interpolated Markov model. For the purposes here, all ORFs with common stop codons are given the same ORF designation and will be treated as if they are the same ORF. As used hereinafter, an ORF is defined as having one of three potential start site codons, ATG, GTG or TTG and one of three potential stop codons, TAA, TAG or TGA. The lower limit of amino acid length selected as a cutoff (e.g., ~74 amino acids) may also cause the algorithms to overlook some reading frames. However, these "true" reading frames become an increasingly rare event as the ORFs become shorter.

The initial annotation of the *Streptococcus pneumoniae* ORFs was performed using the Basic Local Alignment Search Tool (BLAST; version 2.0) Gapped search algorithm, Blastp, to identify homologous sequences (Altschul et al., 1997). A cutoff 'e' value of anything $<e^{-10}$ was considered significant. The non-redundant protein sequence database used for the homology searches consisted of GenBank, SWISS-PROT (Bairoch and Apweiler, 2000), PIR (Barker et al., 2001), and TREMBL (Bairoch and Apweiler, 2000); whose database sequences are updated daily. In the present invention, ORFs with a Blastp result of $>e^{-10}$ are considered to be unique to *Streptococcus pneumoniae*. Alternate quantitative expression values other than Blastp 'e', e.g., percent identity, may also be used to compare database sequences with the *Streptococcus pneumoniae* ORFs of the present invention.

A keyword search of the entire BLAST results was carried out using known or suspected target genes for immunogenic compositions as well as words that identified the location of a protein or function.

Several parameters were used to determine grouping of the predicted *Streptococcus pneumoniae* polypeptides of the invention. For example, polypeptides destined for translocation across the cytoplasmic membrane encode a leader signal (also called signal sequence) composed of a central hydrophobic region flanked at the N-terminus by positively charged residues (Pugsley, 1993). A software program, called SignalP, which identifies signal peptides and their cleavage sites based on neural networks (Nielsen et al., 1997), was used in the present invention to analyze the amino acid sequence of an ORF for such a signal peptide. The first 60 N-terminal amino acids of each ORF were analyzed by SignalP using the Gram-positive software database. The output generated four separate values, maximum C, maximum Y, maximum S, and mean S. The S-score, or signal region, is the probability of the position belonging to the signal peptide. The C-score, or cleavage site, is the probability of the position being the first in the mature protein. The Y-score is the geometric average of the C-score and a smoothed derivative of the S-score. A conclusion of either a Yes or No is given next to each score. If all four conclusions are Yes, then a 'YES' is listed for that ORF; if three of the conclusions are Yes, then a 'Yes' is listed for that ORF; if two of the conclusions are Yes, then a 'maybe' is listed for that ORF; for all other cases, a 'no' is listed for that ORF.

To predict polypeptide localization in bacteria, the software program PSORT was used (Nakai, 1991). PSORT predicts localization of polypeptides to the 'cytoplasm', 'periplasm', and/or 'cytoplasmic membrane' for Gram-positive bacteria, as well as 'outer membrane' for Gram-negative bacteria. Transmembrane (TM) domains of polypeptides were analyzed using the software program TopPred II (Cserzo et al., 1997).

The Hidden Markov Model (HMM) Pfam database (Bateman, 2000) was used to identify *Streptococcus pneumoniae* proteins that may belong to an existing protein family. Keyword searching of this output was further used to help identify additional candidate antigens that may have been missed by the BLAST search criteria.

A computer algorithm, called HMM Lipo, was developed by inventors' assignee to predict lipoproteins using approximately 131 biologically proven bacterial lipoproteins. The protein sequence from the start of the protein to the cysteine amino acid, plus the next two additional amino acids, was used to generate the HMM (Eddy and Markov, 1996)

The inventor's assignee's also developed a HMM using approximately 70 known prokaryotic proteins containing the LPXTG cell wall sorting signal, to predict cell wall proteins that are anchored to the peptidoglycan layer (Mazmanian et al., 1999; Navarre and Schneewind, 1999). The model used not only the LPXTG sequence, but also included two features of the downstream sequence, first the hydrophobic transmembrane domain and secondly, the positively charged carboxy terminus. There are also a number of proteins that interact, non-covalently, with the peptidoglycan layer and are distinct from the LPXTG protein class described above. These proteins seem to have a consensus sequence at their carboxy terminus (Koebnik, 1995). The inventors therefore developed and used a HMM of this region to identify any *Streptococcus pneumoniae* that may fall into this class of proteins.

*Streptococcus pneumoniae* ORFs encoding surface localized, exposed, or membrane associated polypeptides were also identified by proteomics (see, Example 3). This proteomic analysis confirmed many of the *Streptococcus pneumoniae* ORFs identified by the above genomic analysis and further identified novel *Streptococcus pneumoniae* ORFs encoding membrane associated polypeptides.

The following Tables (i.e., Tables 1-12) represent 12 groups into which the ORFs identified according to the above characteristics of present invention have been classified. Thus, all of the groups described below are ORFs comprised within the *Streptococcus pneumoniae* genome and identified as encoding putative surface localized, exposed, membrane associated or secreted polypeptides. These groups are not meant to limit the scope of the present invention, as analysis of additional ORF characteristics also are contemplated. These additional characteristics, e.g., RGD sequence, may serve to further expand the total number of ORF groupings or to parse the presently identified ORFs into more defined groups, broader groups, narrower groups or group subsets. In addition, some ORFs will meet the criteria of more than one category, and will therefore appear in more than one of the following groups.

Listed in Table 1 are ORFs that comprise a cytoplasmic membrane signal sequence (i.e., a SignalP value of 'YES') and have one or fewer membrane spanning domains (MSD), as defined by the TopPred II program. Thirteen ORFs are found that match these criteria and are considered to be surface exposed.

TABLE 1

ORFs encoding surface exposed polypeptides,
SignalP value = 'YES'
and ≦1 MSDs.

| SEQ ID | ORF |
|---|---|
| 11 | 190 |
| 17 | 403 |
| 23 | 469 |
| 39 | 790 |
| 50 | 935 |
| 70 | 1143 |
| 83 | 1475 |
| 91 | 1568 |
| 97 | 1724 |
| 128 | 2271 |
| 148 | 2621 |
| 179 | 3212 |
| 209 | 3600 |

Listed in Table 2 are ORFs that comprise a cytoplasmic membrane signal sequence (i.e., a SignalP value of 'YES') and an outer membrane (OM) or periplasmic (Peri) prediction value when analyzed via the program Psort. Five ORFs are found that match these criteria and are considered to be surface exposed.

TABLE 2

ORFs encoding surface exposed polypeptides,
a SignalP value = 'YES'
and a Psort value of 'OM or Peri'.

| SEQ ID | ORF |
|---|---|
| 23 | 469 |
| 39 | 790 |
| 50 | 935 |
| 125 | 2228 |
| 179 | 3212 |

Listed in Table 3 are ORFs that comprise a comprise a cytoplasmic membrane signal sequence (i.e., a SignalP value of 'YES') and have 2 or more membrane spanning domains (MSD), as defined by the TopPred II program. Twenty two ORFs are found that match these criteria and are considered to be surfaced to be surface exposed.

TABLE 3

ORFs encoding surface exposed polypeptides,
a SignalP = 'YES'
and ≦1 MSDs.

| SEQ ID | ORF |
|---|---|
| 11 | 190 |
| 13 | 339 |
| 17 | 403 |
| 23 | 469 |
| 34 | 640 |
| 39 | 790 |
| 50 | 935 |
| 70 | 1143 |
| 73 | 1207 |
| 83 | 1475 |
| 91 | 1568 |
| 97 | 1724 |
| 106 | 1947 |
| 121 | 2196 |
| 125 | 2228 |
| 126 | 2234 |
| 128 | 2271 |
| 148 | 2621 |
| 179 | 3212 |
| 187 | 3361 |
| 192 | 3384 |
| 209 | 3600 |

Listed in Table 4 are ORFs that comprise at least 3 of 4 SignalP values (i.e., a SignalP value of 'Yes') and have 2 or membrane spanning domains (MSD), as defined by the TopPred II program. Forty-nine ORFs are found that match these criteria and are considered exposed.

TABLE 4

ORFs encoding surface exposed polypeptides,
a SignalP = 'yes'
and ≧2 MSDs.

| SEQ ID | ORF |
|---|---|
| 2 | 72 |
| 6 | 94 |
| 10 | 141 |
| 14 | 356 |
| 22 | 462 |
| 28 | 597 |
| 29 | 598 |
| 36 | 715 |
| 37 | 716 |

TABLE 4-continued

ORFs encoding surface exposed polypeptides, a SignalP = 'yes' and ≧2 MSDs.

| SEQ ID | ORF |
|---|---|
| 40 | 823 |
| 46 | 885 |
| 47 | 904 |
| 48 | 916 |
| 56 | 989 |
| 59 | 998 |
| 71 | 1178 |
| 77 | 1339 |
| 80 | 1412 |
| 81 | 1437 |
| 86 | 1493 |
| 87 | 1528 |
| 88 | 1530 |
| 93 | 1623 |
| 99 | 1816 |
| 101 | 1849 |
| 102 | 1863 |
| 105 | 1904 |
| 112 | 2026 |
| 114 | 2061 |
| 115 | 2112 |
| 120 | 2195 |
| 129 | 2304 |
| 133 | 2350 |
| 140 | 2470 |
| 145 | 2594 |
| 146 | 2613 |
| 152 | 2676 |
| 156 | 2838 |
| 168 | 3072 |
| 175 | 3141 |
| 180 | 3256 |
| 184 | 3340 |
| 188 | 3369 |
| 190 | 3373 |
| 194 | 3386 |
| 203 | 3558 |
| 211 | 3631 |
| 213 | 3770 |
| 215 | 3799 |

Keyword search of the Blastp data for putative surface exposed proteins produced 119 ORFs and are listed in Table 5.

TABLE 5

ORFs encoding surface exposed polypeptides identified by keyword search of Blastp data.

| SEQ ID | ORF |
|---|---|
| 1 | 51 |
| 2 | 72 |
| 7 | 113 |
| 10 | 141 |
| 12 | 304 |
| 16 | 378 |
| 20 | 410 |
| 24 | 493 |
| 27 | 580 |
| 30 | 607 |
| 31 | 612 |
| 32 | 624 |
| 33 | 639 |
| 34 | 640 |
| 35 | 703 |
| 38 | 772 |
| 40 | 823 |
| 42 | 838 |
| 43 | 854 |
| 44 | 855 |
| 48 | 916 |
| 51 | 945 |
| 53 | 979 |
| 59 | 998 |
| 60 | 1013 |
| 61 | 1048 |
| 65 | 1072 |
| 67 | 1104 |
| 68 | 1117 |
| 69 | 1141 |
| 70 | 1143 |
| 71 | 1178 |
| 75 | 1244 |
| 76 | 1267 |
| 77 | 1339 |
| 78 | 1350 |
| 79 | 1410 |
| 80 | 1412 |
| 87 | 1528 |
| 88 | 1530 |
| 90 | 1560 |
| 94 | 1630 |
| 95 | 1632 |
| 96 | 1710 |
| 98 | 1765 |
| 100 | 1835 |
| 103 | 1864 |
| 105 | 1904 |
| 107 | 1966 |
| 108 | 1999 |
| 109 | 2001 |
| 112 | 2026 |
| 113 | 2027 |
| 115 | 2112 |
| 117 | 2132 |
| 118 | 2191 |
| 122 | 2198 |
| 123 | 2201 |
| 124 | 2215 |
| 127 | 2239 |
| 129 | 2304 |
| 131 | 2329 |
| 132 | 2348 |
| 133 | 2350 |
| 134 | 2352 |
| 135 | 2354 |
| 136 | 2385 |
| 138 | 2431 |
| 139 | 2452 |
| 141 | 2488 |
| 144 | 2591 |
| 146 | 2613 |
| 147 | 2615 |
| 151 | 2661 |
| 152 | 2676 |
| 154 | 2734 |
| 155 | 2814 |
| 157 | 2845 |
| 158 | 2847 |
| 159 | 2894 |
| 160 | 2969 |
| 161 | 2975 |
| 162 | 2979 |
| 163 | 2980 |
| 165 | 3039 |
| 166 | 3040 |
| 167 | 3060 |
| 169 | 3079 |
| 172 | 3107 |
| 173 | 3115 |
| 176 | 3167 |
| 177 | 3198 |
| 178 | 3209 |

TABLE 5-continued

ORFs encoding surface exposed polypeptides identified by keyword search of Blastp data.

| SEQ ID | ORF |
|---|---|
| 180 | 3256 |
| 181 | 3262 |
| 182 | 3298 |
| 184 | 3340 |
| 185 | 3346 |
| 186 | 3349 |
| 188 | 3369 |
| 189 | 3372 |
| 191 | 3378 |
| 193 | 3385 |
| 196 | 3457 |
| 197 | 3473 |
| 198 | 3479 |
| 199 | 3480 |
| 200 | 3487 |
| 201 | 3493 |
| 202 | 3494 |
| 204 | 3568 |
| 205 | 3576 |
| 206 | 3578 |
| 207 | 3584 |
| 208 | 3585 |
| 210 | 3627 |
| 212 | 3669 |
| 213 | 3770 |
| 214 | 3789 |

HMM Pfam analysis helps identify ORFs encoding proteins with domains or amino acid patterns similar to proteins that belong to an existing protein family. Keyword search of the Pfam family classification for potential surface exposed proteins produced 52 ORFs and are listed in Table 6.

TABLE 6

ORFs encoding surface exposed polypeptides identified by HMM Pfam analysis.

| SEQ ID | ORF |
|---|---|
| 4 | 79 |
| 18 | 404 |
| 19 | 406 |
| 41 | 828 |
| 45 | 869 |
| 55 | 983 |
| 57 | 992 |
| 58 | 996 |
| 63 | 1064 |
| 64 | 1070 |
| 66 | 1097 |
| 72 | 1179 |
| 74 | 1220 |
| 89 | 1559 |
| 92 | 1572 |
| 104 | 1868 |
| 111 | 2025 |
| 116 | 2129 |
| 119 | 2193 |
| 128 | 2271 |
| 137 | 2400 |
| 142 | 2499 |
| 143 | 2543 |
| 149 | 2642 |
| 151 | 2661 |
| 152 | 2676 |
| 153 | 2678 |
| 157 | 2845 |
| 159 | 2894 |
| 160 | 2969 |

TABLE 6-continued

ORFs encoding surface exposed polypeptides identified by HMM Pfam analysis.

| SEQ ID | ORF |
|---|---|
| 162 | 2979 |
| 163 | 2980 |
| 164 | 2983 |
| 165 | 3039 |
| 166 | 3040 |
| 169 | 3079 |
| 171 | 3083 |
| 174 | 3140 |
| 176 | 3167 |
| 180 | 3256 |
| 182 | 3298 |
| 183 | 3327 |
| 184 | 3340 |
| 186 | 3349 |
| 188 | 3369 |
| 189 | 3372 |
| 195 | 3413 |
| 198 | 3479 |
| 199 | 3480 |
| 205 | 3576 |
| 212 | 3669 |
| 213 | 3770 |

An algorithm called HMM Lipo was developed for use in the present invention. The HMM Lipo program predicts lipoproteins using approximately 131 biologically proven bacterial lipoproteins. HMM Lipo identified 16 ORFs that are putative lipoproteins and are listed in Table 7.

TABLE 7

ORFs encoding surface exposed lipoproteins.

| SEQ ID | ORF |
|---|---|
| 3 | 75 |
| 8 | 132 |
| 9 | 140 |
| 13 | 339 |
| 21 | 423 |
| 26 | 502 |
| 34 | 640 |
| 62 | 1059 |
| 67 | 1104 |
| 85 | 1479 |
| 134 | 2352 |
| 147 | 2615 |
| 150 | 2655 |
| 168 | 3072 |
| 170 | 3081 |
| 173 | 3115 |

The inventors developed an HMM using approximately 70 known prokaryotic polypeptides containing the LPXTG cell wall sorting signal. Thus, this HMM was used to predict cell wall polypeptides that are anchored to the peptidoglycan layer. Listed in Table 8 are 4 ORFs predicted to have the LPXTG motif and are classified as proteins that might be targeted by sortase.

TABLE 8

ORFs encoding surface exposed polypeptides anchored to the peptidoglycan layer.

| SEQ ID | ORF |
|---|---|
| 13 | 339 |
| 21 | 423 |
| 34 | 640 |
| 170 | 3081 |

In addition, listed in Table 9 are 3 ORFs predicted by HMM PGB analysis to encode polypeptides potentially binding to the peptidoglycan layer in a manner independently of the sortase.

TABLE 9

ORFs encoding surface exposed polypeptides non-covalently anchored to the peptidoglycan layer.

| SEQ ID | ORF |
|---|---|
| 25 | 494 |
| 49 | 927 |
| 110 | 2012 |

ORFs that give a SignalP value of 'YES' and whose carboxy terminal amino acid is either a Phenylalanine or Tyrosine are considered to be surface exposed. Listed in Table 10 are 7 ORFs matching these criteria.

TABLE 10

ORFs encoding surface exposed polypeptides, a cytoplasmic membrane signal sequence (i.e., SignalP = 'YES') and a C-terminal Phe or Tyr amino acid.

| SEQ ID | ORF |
|---|---|
| 11 | 190 |
| 39 | 790 |
| 73 | 1207 |
| 97 | 1724 |
| 106 | 1947 |
| 125 | 2228 |
| 187 | 3361 |

Twenty eight *Streptococcus pneumoniae* ORFs were additionally identified by proteomics as encoding membrane associated polypeptides and are listed in Table 11. The ORFs listed in Table 11 further support the *Streptococcus pneumoniae* ORFs identified by the genomic mining algorithms described above (i.e., ORFs encoding surface localized, secreted, or exposed polypeptides; Tables 1-10).

TABLE 11

*Streptococcus pneumoniae* ORFs confirmed by proteomics as surface exposed.

| SEQ ID | ORF |
|---|---|
| 14 | 356 |
| 16 | 378 |
| 17 | 403 |
| 46 | 885 |
| 64 | 1070 |
| 66 | 1097 |
| 67 | 1104 |

TABLE 11-continued

*Streptococcus pneumoniae* ORFs confirmed by proteomics as surface exposed.

| SEQ ID | ORF |
|---|---|
| 69 | 1141 |
| 71 | 1178 |
| 74 | 1220 |
| 91 | 1568 |
| 103 | 1864 |
| 116 | 2129 |
| 128 | 2271 |
| 131 | 2329 |
| 136 | 2385 |
| 151 | 2661 |
| 156 | 2838 |
| 159 | 2894 |
| 162 | 2979 |
| 164 | 2983 |
| 172 | 3107 |
| 176 | 3167 |
| 178 | 3209 |
| 179 | 3212 |
| 180 | 3256 |
| 182 | 3298 |
| 205 | 3576 |

Finally, 161 novel *Streptococcus pneumoniae* ORFs were identified by proteomics as encoding associated polypeptides and are listed in Table 12.

TABLE 12

*Streptococcus pneumoniae* ORFs identified by proteomics as membrane associated.

| SEQ ID | ORF |
|---|---|
| 431 | 64 |
| 432 | 120 |
| 433 | 121 |
| 434 | 152 |
| 435 | 153 |
| 436 | 156 |
| 437 | 159 |
| 438 | 160 |
| 439 | 163 |
| 440 | 164 |
| 441 | 166 |
| 442 | 172 |
| 443 | 174 |
| 444 | 175 |
| 445 | 178 |
| 446 | 180 |
| 447 | 181 |
| 448 | 183 |
| 449 | 186 |
| 450 | 188 |
| 451 | 189 |
| 452 | 192 |
| 453 | 194 |
| 454 | 199 |
| 455 | 268 |
| 456 | 269 |
| 457 | 294 |
| 458 | 296 |
| 459 | 298 |
| 460 | 301 |
| 461 | 316 |
| 462 | 320 |
| 463 | 357 |
| 464 | 390 |
| 465 | 431 |
| 466 | 434 |
| 467 | 436 |
| 468 | 439 |
| 469 | 513 |

TABLE 12-continued

Streptococcus pneumoniae ORFs identified by proteomics as membrane associated.

| SEQ ID | ORF |
|---|---|
| 470 | 515 |
| 471 | 583 |
| 472 | 633 |
| 473 | 683 |
| 474 | 686 |
| 475 | 720 |
| 476 | 726 |
| 477 | 818 |
| 478 | 861 |
| 479 | 863 |
| 480 | 960 |
| 481 | 1004 |
| 482 | 1037 |
| 483 | 1049 |
| 484 | 1054 |
| 485 | 1061 |
| 486 | 1082 |
| 487 | 1105 |
| 488 | 1111 |
| 489 | 1175 |
| 490 | 1248 |
| 491 | 1262 |
| 492 | 1266 |
| 493 | 1312 |
| 494 | 1314 |
| 495 | 1344 |
| 496 | 1347 |
| 497 | 1356 |
| 498 | 1417 |
| 499 | 1465 |
| 500 | 1477 |
| 501 | 1515 |
| 502 | 1527 |
| 503 | 1565 |
| 504 | 1601 |
| 505 | 1606 |
| 506 | 1641 |
| 507 | 1770 |
| 508 | 1773 |
| 509 | 1774 |
| 510 | 1785 |
| 511 | 1803 |
| 512 | 1817 |
| 513 | 1823 |
| 514 | 1847 |
| 515 | 1917 |
| 516 | 1923 |
| 517 | 1964 |
| 518 | 1970 |
| 519 | 2039 |
| 520 | 2041 |
| 521 | 2047 |
| 522 | 2058 |
| 523 | 2068 |
| 524 | 2130 |
| 525 | 2251 |
| 526 | 2282 |
| 527 | 2284 |
| 528 | 2315 |
| 529 | 2317 |
| 530 | 2318 |
| 531 | 2319 |
| 532 | 2320 |
| 533 | 2372 |
| 534 | 2374 |
| 535 | 2376 |
| 536 | 2387 |
| 537 | 2394 |
| 538 | 2410 |
| 539 | 2425 |
| 540 | 2443 |
| 541 | 2451 |
| 542 | 2454 |
| 543 | 2508 |
| 544 | 2513 |
| 545 | 2542 |
| 546 | 2558 |
| 547 | 2568 |
| 548 | 2575 |
| 549 | 2587 |
| 550 | 2754 |
| 551 | 2800 |
| 552 | 2839 |
| 553 | 2892 |
| 554 | 2906 |
| 555 | 2958 |
| 556 | 2963 |
| 557 | 3021 |
| 558 | 3048 |
| 559 | 3065 |
| 560 | 3095 |
| 561 | 3111 |
| 562 | 3125 |
| 563 | 3151 |
| 564 | 3153 |
| 565 | 3161 |
| 566 | 3178 |
| 567 | 3180 |
| 568 | 3234 |
| 569 | 3248 |
| 570 | 3303 |
| 571 | 3331 |
| 572 | 3367 |
| 573 | 3410 |
| 574 | 3446 |
| 575 | 3454 |
| 576 | 3525 |
| 577 | 3538 |
| 578 | 3540 |
| 579 | 3552 |
| 580 | 3555 |
| 581 | 3560 |
| 582 | 3564 |
| 583 | 3566 |
| 584 | 3632 |
| 585 | 3653 |
| 586 | 3714 |
| 587 | 3732 |
| 588 | 3735 |
| 589 | 3739 |
| 590 | 3766 |
| 591 | 3778 |

As further contemplated in the present invention, *Streptococcus pneumoniae* ORFs are searched and evaluated for other important characteristics. For example, proteins that contain the Arg-Gly-Asp (RGD) attachment motif, together with integrins that serve as their receptor, constitute a major recognition system for cell adhesion, and thus are putative *Streptococcus pneumoniae* polypeptide antigens. Four *Streptococcus pneumoniae* ORFs, i.e., ORF 51, ORF 423, ORF 1097 and ORF 1104, have been identified as having a tripeptide RGD sequence that potentially is involved in cell attachment.

ORFs RGD recognition is one mechanism used by microbes to gain entry into tissues (Stockbauer et al., 1999; Isberg and Nhieu, 1994). However, not all RGD-containing proteins mediate cell attachment. It has been shown that RGD-containing peptides with a proline at the carboxy end (RGDP) are inactive in cell attachment assays (Pierschbacher and Rouslahti, 1987) and are excluded. A tandem repeat finder (Benson, 1999) may also be used, as has been used to identify ORFs containing repeated DNA sequences such as those found in MSCRAMMs (Foster and Hook, 1998) and phase variable surface proteins of *Neisseria meningitidis* (Parkhill et al., 2000).

The present inventors also have used the Geanfammer software to cluster proteins into homologous families (Park and Teichmann, 1998). Preliminary analysis of the family classes has provided novel ORFs within a vaccine candidate cluster as well as defining potential protein function.

The ORFs listed in Table 13, were identified by analysis of the *Streptococcus pneumoniae* genome. A total of 215 ORFs were identified based on the analysis criteria described above and listed in Tables 1-10. The 215 ORFs identified are listed vertically in Table 13 (column 1). The nucleotide SEQ ID NOS: 1 through SEQ ID NOS: 215 (column 2) and the encoded polypeptide SEQ ID NOS: 216 through SEQ ID NOS: 430 (column 3) are listed horizontally to their respective ORF. For example, in Table 13, ORF 51 has the nucleotide sequence of SEQ ID NO:1 and the encoded polypeptide has the amino acid sequence of SEQ ID NO: 216, ORF 72 has nucleotide SEQ ID NO:2 and encoded polypeptide SEQ ID NO: 217, etc.

Proteomic analysis identified twenty eight ORFs (see, Table 11) already listed in Table 13 (e.g., SEQ ID NO: 14, SEQ ID NO:16, SEQ ID NO:27, etc.) Proteomic analysis further identified 161 novel ORFs encoding membrane associated proteins (see, Table 12). These 161 novel ORFs identified by proteomics as membrane associated are listed vertically in Table 14 (column 1). The nucleotide SEQ ID NOS: 431 through SEQ ID NO: 591 (column 2) and the encoded polypeptide SEQ ID NOS: 592 through 752 (column 3) are listed horizontally to their respective ORF.

TABLE 13

*Streptococcus Pneumoniae* open reading frames (ORFs)

| ORF | Nucleotide SEQ ID NO | Polypeptide SEQ ID NO |
|---|---|---|
| 51 | 1 | 216 |
| 72 | 2 | 217 |
| 75 | 3 | 218 |
| 79 | 4 | 219 |
| 86 | 5 | 220 |
| 94 | 6 | 221 |
| 113 | 7 | 222 |
| 132 | 8 | 223 |
| 140 | 9 | 224 |
| 141 | 10 | 225 |
| 190 | 11 | 226 |
| 304 | 12 | 227 |
| 339 | 13 | 228 |
| 356 | 14 | 229 |
| 370 | 15 | 230 |
| 378 | 16 | 231 |
| 403 | 17 | 232 |
| 404 | 18 | 233 |
| 406 | 19 | 234 |
| 410 | 20 | 235 |
| 423 | 21 | 236 |
| 462 | 22 | 237 |
| 469 | 23 | 238 |
| 493 | 24 | 239 |
| 494 | 25 | 240 |
| 502 | 26 | 241 |
| 580 | 27 | 242 |
| 597 | 28 | 243 |
| 598 | 29 | 244 |
| 607 | 30 | 245 |
| 612 | 31 | 246 |
| 624 | 32 | 247 |
| 639 | 33 | 248 |
| 640 | 34 | 249 |
| 703 | 35 | 250 |

TABLE 13-continued

*Streptococcus Pneumoniae* open reading frames (ORFs)

| ORF | Nucleotide SEQ ID NO | Polypeptide SEQ ID NO |
|---|---|---|
| 715 | 36 | 251 |
| 716 | 37 | 252 |
| 772 | 38 | 253 |
| 790 | 39 | 254 |
| 823 | 40 | 255 |
| 823 | 40 | 255 |
| 828 | 41 | 256 |
| 838 | 42 | 257 |
| 854 | 43 | 258 |
| 855 | 44 | 259 |
| 869 | 45 | 260 |
| 885 | 46 | 261 |
| 904 | 47 | 262 |
| 916 | 48 | 263 |
| 927 | 49 | 264 |
| 935 | 50 | 265 |
| 945 | 51 | 266 |
| 965 | 52 | 267 |
| 979 | 53 | 268 |
| 980 | 54 | 269 |
| 983 | 55 | 270 |
| 989 | 56 | 271 |
| 992 | 57 | 272 |
| 996 | 58 | 273 |
| 998 | 59 | 274 |
| 1013 | 60 | 275 |
| 1048 | 61 | 276 |
| 1059 | 62 | 277 |
| 1064 | 63 | 278 |
| 1070 | 64 | 279 |
| 1072 | 65 | 280 |
| 1097 | 66 | 281 |
| 1104 | 67 | 282 |
| 1117 | 68 | 283 |
| 1141 | 69 | 284 |
| 1143 | 70 | 285 |
| 1178 | 71 | 286 |
| 1179 | 72 | 287 |
| 1207 | 73 | 288 |
| 1220 | 74 | 289 |
| 1244 | 75 | 290 |
| 1267 | 76 | 291 |
| 1339 | 77 | 292 |
| 1350 | 78 | 293 |
| 1410 | 79 | 294 |
| 1412 | 80 | 295 |
| 1437 | 81 | 296 |
| 1459 | 82 | 297 |
| 1475 | 83 | 298 |
| 1476 | 84 | 299 |
| 1479 | 85 | 300 |
| 1493 | 86 | 301 |
| 1528 | 87 | 302 |
| 1530 | 88 | 303 |
| 1559 | 89 | 304 |
| 1560 | 90 | 305 |
| 1568 | 91 | 306 |
| 1572 | 92 | 307 |
| 1623 | 93 | 308 |
| 1630 | 94 | 309 |
| 1632 | 95 | 310 |
| 1710 | 96 | 311 |
| 1724 | 97 | 312 |
| 1765 | 98 | 313 |
| 1816 | 99 | 314 |
| 1835 | 100 | 315 |
| 1849 | 101 | 316 |
| 1863 | 102 | 317 |
| 1864 | 103 | 318 |
| 1868 | 104 | 319 |
| 1904 | 105 | 320 |
| 1947 | 106 | 321 |
| 1966 | 107 | 322 |
| 1999 | 108 | 323 |

TABLE 13-continued

Streptococcus Pneumoniae open reading frames (ORFs)

| ORF | Nucleotide SEQ ID NO | Polypeptide SEQ ID NO |
|---|---|---|
| 2001 | 109 | 324 |
| 2012 | 110 | 325 |
| 2025 | 111 | 326 |
| 2026 | 112 | 327 |
| 2027 | 113 | 328 |
| 2061 | 114 | 329 |
| 2112 | 115 | 330 |
| 2129 | 116 | 331 |
| 2132 | 117 | 332 |
| 2191 | 118 | 333 |
| 2193 | 119 | 334 |
| 2195 | 120 | 335 |
| 2196 | 121 | 336 |
| 2198 | 122 | 337 |
| 2201 | 123 | 338 |
| 2215 | 124 | 339 |
| 2228 | 125 | 340 |
| 2234 | 126 | 341 |
| 2239 | 127 | 342 |
| 2271 | 128 | 343 |
| 2304 | 129 | 344 |
| 2322 | 130 | 345 |
| 2329 | 131 | 346 |
| 2348 | 132 | 347 |
| 2350 | 133 | 348 |
| 2352 | 134 | 349 |
| 2354 | 135 | 350 |
| 2385 | 136 | 351 |
| 2400 | 137 | 352 |
| 2431 | 138 | 353 |
| 2452 | 139 | 354 |
| 2470 | 140 | 355 |
| 2488 | 141 | 356 |
| 2499 | 142 | 357 |
| 2543 | 143 | 358 |
| 2591 | 144 | 359 |
| 2594 | 145 | 360 |
| 2613 | 146 | 361 |
| 2615 | 147 | 362 |
| 2621 | 148 | 363 |
| 2642 | 149 | 364 |
| 2655 | 150 | 365 |
| 2661 | 151 | 366 |
| 2676 | 152 | 367 |
| 2678 | 153 | 368 |
| 2734 | 154 | 369 |
| 2814 | 155 | 370 |
| 2838 | 156 | 371 |
| 2845 | 157 | 372 |
| 2847 | 158 | 373 |
| 2894 | 159 | 374 |
| 2969 | 160 | 375 |
| 2975 | 161 | 376 |
| 2979 | 162 | 377 |
| 2980 | 163 | 378 |
| 2983 | 164 | 379 |
| 3039 | 165 | 380 |
| 3040 | 166 | 381 |
| 3060 | 167 | 382 |
| 3072 | 168 | 383 |
| 3079 | 169 | 384 |
| 3081 | 170 | 385 |
| 3083 | 171 | 386 |
| 3107 | 172 | 387 |
| 3115 | 173 | 388 |
| 3140 | 174 | 389 |
| 3141 | 175 | 390 |
| 3167 | 176 | 391 |
| 3198 | 177 | 392 |
| 3209 | 178 | 393 |
| 3212 | 179 | 394 |
| 3256 | 180 | 395 |
| 3262 | 181 | 396 |
| 3298 | 182 | 397 |
| 3327 | 183 | 398 |
| 3340 | 184 | 399 |
| 3346 | 185 | 400 |
| 3349 | 186 | 401 |
| 3361 | 187 | 402 |
| 3369 | 188 | 403 |
| 3372 | 189 | 404 |
| 3373 | 190 | 405 |
| 3378 | 191 | 406 |
| 3384 | 192 | 407 |
| 3385 | 193 | 408 |
| 3386 | 194 | 409 |
| 3413 | 195 | 410 |
| 3457 | 196 | 411 |
| 3473 | 197 | 412 |
| 3479 | 198 | 413 |
| 3480 | 199 | 414 |
| 3487 | 200 | 415 |
| 3493 | 201 | 416 |
| 3494 | 202 | 417 |
| 3558 | 203 | 418 |
| 3568 | 204 | 419 |
| 3576 | 205 | 420 |
| 3578 | 206 | 421 |
| 3584 | 207 | 422 |
| 3585 | 208 | 423 |
| 3600 | 209 | 424 |
| 3627 | 210 | 425 |
| 3631 | 211 | 426 |
| 3669 | 212 | 427 |
| 3770 | 213 | 428 |
| 3789 | 214 | 429 |
| 3799 | 215 | 430 |

TABLE 14

Streptococcus Pneumoniae open reading frames (ORFs)

| ORF | Nucleotide SEQ ID NO | Polypeptide SEQ ID NO |
|---|---|---|
| 64 | 431 | 592 |
| 120 | 432 | 593 |
| 121 | 433 | 594 |
| 152 | 434 | 595 |
| 153 | 435 | 596 |
| 156 | 436 | 597 |
| 159 | 437 | 598 |
| 160 | 438 | 599 |
| 163 | 439 | 600 |
| 164 | 440 | 601 |
| 166 | 441 | 602 |
| 172 | 442 | 603 |
| 174 | 443 | 604 |
| 175 | 444 | 605 |
| 178 | 445 | 606 |
| 180 | 446 | 607 |
| 181 | 447 | 608 |
| 183 | 448 | 609 |
| 186 | 449 | 610 |
| 188 | 450 | 611 |
| 189 | 451 | 612 |
| 192 | 452 | 613 |
| 194 | 453 | 614 |
| 199 | 454 | 615 |
| 268 | 455 | 616 |
| 269 | 456 | 617 |
| 294 | 457 | 618 |
| 296 | 458 | 619 |
| 298 | 459 | 620 |
| 301 | 460 | 621 |

TABLE 14-continued

Streptococcus Pneumoniae open reading frames (ORFs)

| ORF | Nucleotide SEQ ID NO | Polypeptide SEQ ID NO |
|---|---|---|
| 316 | 461 | 622 |
| 320 | 462 | 623 |
| 357 | 463 | 624 |
| 390 | 464 | 625 |
| 431 | 465 | 626 |
| 434 | 466 | 627 |
| 436 | 467 | 628 |
| 439 | 468 | 629 |
| 513 | 469 | 630 |
| 515 | 470 | 631 |
| 583 | 471 | 632 |
| 633 | 472 | 633 |
| 683 | 473 | 634 |
| 686 | 474 | 635 |
| 720 | 475 | 636 |
| 726 | 476 | 637 |
| 818 | 477 | 638 |
| 861 | 478 | 639 |
| 863 | 479 | 640 |
| 960 | 480 | 641 |
| 1004 | 481 | 642 |
| 1037 | 482 | 643 |
| 1049 | 483 | 644 |
| 1054 | 484 | 645 |
| 1061 | 485 | 646 |
| 1082 | 486 | 647 |
| 1105 | 487 | 648 |
| 1111 | 488 | 649 |
| 1175 | 489 | 650 |
| 1248 | 490 | 651 |
| 1262 | 491 | 652 |
| 1266 | 492 | 653 |
| 1312 | 493 | 654 |
| 1314 | 494 | 655 |
| 1344 | 495 | 656 |
| 1347 | 496 | 657 |
| 1356 | 497 | 658 |
| 1417 | 498 | 659 |
| 1465 | 499 | 660 |
| 1477 | 500 | 661 |
| 1515 | 501 | 662 |
| 1527 | 502 | 663 |
| 1565 | 503 | 664 |
| 1601 | 504 | 665 |
| 1606 | 505 | 666 |
| 1641 | 506 | 667 |
| 1770 | 507 | 668 |
| 1773 | 508 | 669 |
| 1774 | 509 | 670 |
| 1785 | 510 | 671 |
| 1803 | 511 | 672 |
| 1817 | 512 | 673 |
| 1823 | 513 | 674 |
| 1847 | 514 | 675 |
| 1917 | 515 | 676 |
| 1923 | 516 | 677 |
| 1964 | 517 | 678 |
| 1970 | 518 | 679 |
| 2039 | 519 | 680 |
| 2041 | 520 | 681 |
| 2047 | 521 | 682 |
| 2058 | 522 | 683 |
| 2068 | 523 | 684 |
| 2130 | 524 | 685 |
| 2251 | 525 | 686 |
| 2282 | 526 | 687 |
| 2284 | 527 | 688 |
| 2315 | 528 | 689 |
| 2317 | 529 | 690 |
| 2318 | 530 | 691 |
| 2319 | 531 | 692 |
| 2320 | 532 | 693 |
| 2372 | 533 | 694 |
| 2374 | 534 | 695 |
| 2376 | 535 | 696 |
| 2387 | 536 | 697 |
| 2394 | 537 | 698 |
| 2410 | 538 | 699 |
| 2425 | 539 | 700 |
| 2443 | 540 | 701 |
| 2451 | 541 | 702 |
| 2454 | 542 | 703 |
| 2508 | 543 | 704 |
| 2513 | 544 | 705 |
| 2542 | 545 | 706 |
| 2558 | 546 | 707 |
| 2568 | 547 | 708 |
| 2575 | 548 | 709 |
| 2587 | 549 | 710 |
| 2754 | 550 | 711 |
| 2800 | 551 | 712 |
| 2839 | 552 | 713 |
| 2892 | 553 | 714 |
| 2906 | 554 | 715 |
| 2958 | 555 | 716 |
| 2963 | 556 | 717 |
| 3021 | 557 | 718 |
| 3048 | 558 | 719 |
| 3065 | 559 | 720 |
| 3095 | 560 | 721 |
| 3111 | 561 | 722 |
| 3125 | 562 | 723 |
| 3151 | 563 | 724 |
| 3153 | 564 | 725 |
| 3161 | 565 | 726 |
| 3178 | 566 | 727 |
| 3180 | 567 | 728 |
| 3234 | 568 | 729 |
| 3248 | 569 | 730 |
| 3303 | 570 | 731 |
| 3331 | 571 | 732 |
| 3367 | 572 | 733 |
| 3410 | 573 | 734 |
| 3446 | 574 | 735 |
| 3454 | 575 | 736 |
| 3525 | 576 | 737 |
| 3538 | 577 | 738 |
| 3540 | 578 | 739 |
| 3552 | 579 | 740 |
| 3555 | 580 | 741 |
| 3560 | 581 | 742 |
| 3564 | 582 | 743 |
| 3566 | 583 | 744 |
| 3632 | 584 | 745 |
| 3653 | 585 | 746 |
| 3714 | 586 | 747 |
| 3732 | 587 | 748 |
| 3735 | 588 | 749 |
| 3739 | 589 | 750 |
| 3766 | 590 | 751 |
| 3778 | 591 | 752 |

B. *Streptococcus Pneumoniae* ORF Polynucleotides Encoding Surface Exposed Polypeptides Isolated and purified *Streptococcus pneumoniae* ORF polynucleotides of the present invention are contemplated for use in the production of *Streptococcus pneumoniae* polypeptides. More specifically, in certain embodiments, the ORFs encode *Streptococcus pneumoniae* surface localized, exposed, membrane associated or secreted polypeptides, particularly antigenic polypeptides. Thus, in one aspect, the present invention provides isolated and purified polynucleotides (ORFs) that encode *Streptococcus pneumoniae* surface localized, exposed, membrane associated or secreted polypeptides. In particular embodiments, a polynucleotide of the present invention is a DNA molecule, wherein the DNA may be genomic DNA, chromosomal DNA, plasmid DNA or cDNA. In a preferred embodiment, a polynucleotide of the present invention is a recombinant polynucleotide, which encodes a *Streptococcus pneumoniae* polypeptide comprising an amino acid sequence that has at least 95% identity to an amino acid sequence of one of SEQ ID NO: 216 through SEQ ID NO: 430 or SEQ ID NO: 592 through SEQ ID No: 752, or a fragment thereof. In another embodiment, an isolated and purified ORF polynucleotide comprises nucleotide sequence that has at least 95% identity to one of the ORF nucleotide sequences of SEQ ID NO: 1 through SEQ ID NO: 215 or SEQ ID NO: 431 through SEQ ID NO: 591, a degenerate variant thereof, or a complement thereof. In a preferred embodiment, an ORF polynucleotide of one of SEQ ID NO: 1 through SEQ ID NO: 215 or SEQ ID NO: 431 through SEQ ID NO: 591 is comprised in a plasmid vector and expressed in a prokaryotic host cell.

As used hereinafter, the term "polynucleotide" means a sequence of nucleotides connected by phosphodiester linkages. Polynucleotides are presented hereinafter in the direction from the 5' to the 3' direction. A polynucleotide of the present invention can comprise from about 10 to about several hundred thousand base pairs. Preferably, a polynucleotide comprises from about 10 to about 3,000 base pairs. Preferred lengths of particular polynucleotide are set forth hereinafter.

A polynucleotide of the present invention can be a deoxyribonucleic acid (DNA) molecule, a ribonucleic acid (RNA) molecule, or analogs of the DNA or RNA generated using nucleotide analogs. The nucleic acid molecule can be single-stranded or double-stranded, but preferably is double-stranded DNA. Where a polynucleotide is a DNA molecule, that molecule can be a gene, a cDNA molecule or a genomic DNA molecule. Nucleotide bases are indicated hereinafter by a single letter code: adenine (A), guanine (G), thymine (T), cytosine (C), inosine (I) and uracil (U).

"Isolated" means altered "by the hand of man" from the natural state. If an "isolated" composition or substance occurs in nature, it has been changed or removed from its original environment, or both. For example, a polynucleotide or a polypeptide naturally present in a living animal is not "isolated," but the same polynucleotide or polypeptide separated from the coexisting materials of its natural state is "isolated," as the term is employed hereinafter.

Preferably, an "isolated" polynucleotide is free of sequences which naturally flank the nucleic acid (i.e., sequences located at the 5' and 3' ends of the nucleic acid) in the genomic DNA of the organism from which the nucleic acid is derived. For example, in various embodiments, the isolated *Streptococcus pneumoniae* nucleic acid molecule can contain less than about 5 kb, 4 kb, 3 kb, 2 kb, 1 kb, 0.5 kb or 0.1 kb of nucleotide sequences which naturally flank the nucleic acid molecule in genomic DNA of the cell from which the nucleic acid is derived. However, the *Streptococcus pneumoniae* nucleic acid molecule can be fused to other protein encoding or regulatory sequences and still be considered isolated.

ORF polynucleotides of the present invention may be obtained, using standard cloning and screening techniques, from a cDNA library derived from mRNA. Polynucleotides of the invention can also be obtained from natural sources such as genomic DNA libraries (e.g., a *Streptococcus pneumoniae* library) or can be synthesized using well known and commercially available techniques. Contemplated in the present invention, ORF polynucleotides will be obtained using *Streptococcus pneumoniae* type 3, type 14 or type 19F chromosomal DNA as the template.

The invention further encompasses nucleic acid molecules that differ from the nucleotide sequences shown in SEQ ID NO:1 through SEQ ID NO:215 or SEQ ID NO: 431 through SEQ ID NO: 591 (and fragments thereof) due to degeneracy of the genetic code and thus encode the same *Streptococcus pneumoniae* polypeptide as that encoded by the nucleotide sequence shown SEQ ID NO:1 through SEQ ID NO:215 or SEQ ID NO: 431 through SEQ ID NO: 591.

Orthologues and allelic variants of the *Streptococcus pneumoniae* polynucleotides can readily be identified using methods well known in the art. Allelic variants and orthologues of the polynucleotides will comprise a nucleotide sequence that is typically at least about 70-75%, more typically at least about 80-85%, and most typically at least about 90-95% or more homologous to the nucleotide sequence shown in SEQ ID NO:1 through SEQ ID NO:215 or SEQ ID NO: 431 through SEQ ID NO: 591, or a fragment of these nucleotide sequences. Such nucleic acid molecules can readily be identified as being able to hybridize, preferably under stringent conditions, to the nucleotide sequence shown in SEQ ID NO:1 through SEQ ID NO:215 or SEQ ID NO: 431 through SEQ ID NO: 591, or a fragment of these nucleotide sequences.

Moreover, the polynucleotide of the invention can comprise only a fragment of the coding region of a *Streptococcus pneumoniae* polynucleotide or gene, such as a fragment of one of SEQ ID NO:1 through SEQ ID NO:215 or SEQ ID NO: 431 through SEQ ID NO: 591. Preferably, such fragments are immunogenic fragments.

When the ORF polynucleotides of the invention are used for the recombinant production of *Streptococcus pneumoniae* polypeptides of the present invention, the polynucleotide may include the coding sequence for the mature polypeptide, by itself, or the coding sequence for the mature polypeptide in reading frame with other coding sequences, such as those encoding a leader or secretory sequence, a pre-, or pro- or prepro-protein sequence, or other fusion peptide portions. For example, a marker sequence which facilitates purification of the fused polypeptide can be linked to the coding sequence (see Gentz et al., 1989, incorporated by reference hereinafter in its entirety). Thus, contemplated in the present invention is the preparation of polynucleotides encoding fusion polypeptides permitting His-tag purification of expression products. The polynucleotide may also contain non-coding 5' and 3' sequences, such as transcribed, non-translated sequences, splicing and polyadenylation signals.

Thus, a polynucleotide encoding a polypeptide of the present invention, including homologs and orthologs from species other than *Streptococcus pneumoniae*, may be obtained by a process which comprises the steps of screening an appropriate library under stringent hybridization conditions with a labeled probe having the sequence of one of SEQ ID NO:1 through SEQ ID NO:215 or SEQ ID NO: 431 through SEQ ID NO: 591, a fragment thereof; and isolating full-length cDNA and genomic clones containing the polynucleotide sequence. Such hybridization techniques are well known to the skilled artisan. The skilled artisan will appreciate that, in many cases, an isolated cDNA sequence will be incomplete, in that the region coding for the polypeptide is cut short at the 5' end of the cDNA. This is a consequence of reverse transcriptase, an enzyme with inherently low "processivity" (a measure of the ability of the enzyme to remain attached to the template during the polymerization reaction), failing to complete a DNA copy of the mRNA template during 1st strand cDNA synthesis.

Thus, in certain embodiments, the polynucleotide sequence information provided by the present invention allows for the preparation of relatively short DNA (or RNA) oligonucleotide sequences having the ability to specifically hybridize to gene sequences of the selected polynucleotides disclosed hereinafter. The term "oligonucleotide" as used hereinafter is defined as a molecule comprised of two or more deoxyribonucleotides or ribonucleotides, usually more than three (3), and typically more than ten (10) and up to one hundred (100) or more (although preferably between twenty and thirty). The exact size will depend on many factors, which in turn depends on the ultimate function or use of the oligonucleotide. Thus, in particular embodiments of the invention, nucleic acid probes of an appropriate length are prepared based on a consideration of a selected nucleotide sequence, e.g., a sequence such as that shown in SEQ ID NO:1 through SEQ ID NO:215 or SEQ ID NO: 431 through SEQ ID NO: 591. The ability of such nucleic acid probes to specifically hybridize to a polynucleotide encoding a *Streptococcus pneumoniae* polypeptide lends them particular utility in a variety of embodiments. Most importantly, the probes can be used in a variety of assays for detecting the presence of complementary sequences in a given sample.

In certain embodiments, it is advantageous to use oligonucleotide primers. These primers may be generated in any manner, including chemical synthesis, DNA replication, reverse transcription, or a combination thereof. The sequence of such primers is designed using a polynucleotide of the present invention for use in detecting, amplifying or mutating a defined segment of an ORF polynucleotide that encodes a *Streptococcus pneumoniae* polypeptide from prokaryotic cells using polymerase chain reaction (PCR) technology.

In certain embodiments, it is advantageous to employ a polynucleotide of the present invention in combination with an appropriate label for detecting hybrid formation. A wide variety of appropriate labels are known in the art, including radioactive, enzymatic or other ligands, such as avidin/ biotin, which are capable of giving a detectable signal.

Polynucleotides which are identical or sufficiently identical to a nucleotide sequence contained in one of SEQ ID NO:1 through SEQ ID NO:215 or SEQ ID NO: 431 through SEQ ID NO: 591, or a fragment thereof, may be used as hybridization probes for cDNA and genomnic DNA or as primers for a nucleic acid amplification (PCR) reaction, to isolate full-length cDNAs and genomic clones encoding polypeptides of the present invention and to isolate cDNA and genomic clones of other genes (including genes encoding homologs and orthologs from species other than *Streptococcus pneumoniae*) that have a high sequence similarity to the polynucleotide sequences set forth in of SEQ ID NO:1 through SEQ ID NO:215 or SEQ ID NO: 431 through SEQ ID NO: 591, or a fragment thereof. Typically these nucleotide sequences are from at least about 70% identical to at least about 95% identical to that of the reference polynucleotide sequence. The probes or primers will generally comprise at least 15 nucleotides, preferably, at least 30 nucleotides and may have at least 50 nucleotides. Particularly preferred probes will have between 30 and 50 nucleotides.

There are several methods available and well known to those skilled in the art to obtain full-length cDNAs, or extend short cDNAs, for example those based on the method of Rapid Amplification of cDNA ends (RACE) (see, Frohman et al., 1988). Recent modifications of the technique, exemplified by the Marathon™ technology (Clontech Laboratories Inc.) for example, have significantly simplified the search for longer cDNAs. In the Marathon™ technology, cDNAs have been prepared from mRNA extracted from a chosen tissue and an "adaptor" sequence ligated onto each end. Nucleic acid amplification (PCR) is then carried out to amplify the "missing" 5' end of the cDNA using a combination of gene specific and adaptor specific oligonucleotide primers. The PCR reaction is then repeated using "nested" primers, that is, primers designed to anneal within the amplified product (typically an adaptor specific primer that anneals further 3' in the adaptor sequence and a gene specific primer that anneals further 5' in the known gene sequence). The products of this reaction can then be analyzed by DNA sequencing and a full-length cDNA constructed either by joining the product directly to the existing cDNA to give a complete sequence, or carrying out a separate full-length PCR using the new sequence information for the design of the 5' primer.

To provide certain of the advantages in accordance with the present invention, a preferred nucleic acid sequence employed for hybridization studies or assays includes probe molecules that are complementary to at least a 10 to about 70 nucleotides long stretch of a polynucleotide that encodes a *Streptococcus pneumoniae* polypeptide, such as that shown in one of SEQ ID NO:216 through SEQ ID NO:430 or SEQ ID NO: 592 through SEQ ID NO: 752. A size of at least 10 nucleotides in length helps to ensure that the fragment will be of sufficient length to form a duplex molecule that is both stable and selective. Molecules having complementary sequences over stretches greater than 10 bases in length are generally preferred, though, in order to increase stability and selectivity of the hybrid, and thereby improve the quality and degree of specific hybrid molecules obtained. One will generally prefer to design nucleic acid molecules having gene-complementary stretches of 25 to 40 nucleotides, 55 to 70 nucleotides, or even longer where desired. Such fragments can be readily prepared by, for example, directly synthesizing the fragment by chemical means, by application of nucleic acid reproduction technology, such as the PCR technology of (U.S. Pat. No. 4,683, 202, incorporated hereinafter by reference) or by excising selected DNA fragments from recombinant plasmids containing appropriate inserts and suitable restriction enzyme sites.

In another aspect, the present invention contemplates an isolated and purified polynucleotide comprising a nucleotide sequence that is identical or complementary to a segment of at least 10 contiguous bases of one of SEQ ID NO:1 through SEQ ID NO:215 or SEQ ID NO: 431 through SEQ ID NO: 591, wherein the polynucleotide hybridizes to a polynucleotide that encodes a *Streptococcus pneumoniae* polypeptide. Preferably, the isolated and purified polynucleotide comprises a base sequence that is identical or complementary to a segment of at least 25 to about 70 contiguous bases of one of SEQ ID NO:1 through SEQ ID NO:215 or SEQ ID NO: 431 through SEQ ID NO: 591. For example, the polynucleotide of the invention can comprise a segment of bases identical or complementary to 40 or 55 contiguous bases of the disclosed nucleotide sequences.

Accordingly, a polynucleotide probe molecule of the invention can be used for its ability to selectively form duplex molecules with complementary stretches of the gene. Depending on the application envisioned, one will desire to employ varying conditions of hybridization to achieve varying degree of selectivity of the probe toward the target sequence (see Table 15 below). For applications requiring a high degree of selectivity, one will typically desire to employ relatively stringent conditions to form the hybrids. Of course, for some applications, for example, where one desires to prepare mutants employing a mutant primer strand hybridized to an underlying template or where one seeks to isolate a *Streptococcus pneumoniae* homologous polypeptide coding sequence from other cells, functional equivalents, or the like, less stringent hybridization conditions are typically needed to allow formation of the heteroduplex (see Table 15). Cross-hybridizing species can thereby be readily identified as positively hybridizing signals with respect to control hybridizations. Thus, hybridization conditions are readily manipulated, and thus will generally be a method of choice depending on the desired results.

Of course, for some applications, for example, where one desires to prepare mutants employing a mutant primer strand hybridized to an underlying template or where one seeks to isolate a homologous polypeptide coding sequence from other cells, functional equivalents, or the like, less stringent hybridization conditions are typically needed to allow formation of the heteroduplex. Cross-hybridizing species are thereby readily identified as positively hybridizing signals with respect to control hybridizations. In any case, it is generally appreciated that conditions can be rendered more stringent by the addition of increasing amounts of formamide, which serves to destabilize the hybrid duplex in the same manner as increased temperature. Thus, hybridization conditions are readily manipulated, and thus will generally be a method of choice depending on the desired results.

The present invention also includes polynucleotides capable of hybridizing under reduced stringency conditions, more preferably stringent conditions, and most preferably highly stringent conditions, to polynucleotides described hereinafter. Examples of stringency conditions are shown in the table below: highly stringent conditions are those that are at least as stringent as, for example, conditions A-F; stringent conditions are at least as stringent as, for example, conditions G-L; and reduced stringency conditions are at least as stringent as, for example, conditions M-R.

TABLE 15

Stringency Conditions

| Stringency Condition | Poly- nucleotide Hybrid | Hybrid Length (bp)$^I$ | Hybridization Temperature and Buffer$^H$ | Wash Temperature and Buffer$^H$ |
|---|---|---|---|---|
| A | DNA:DNA | >50 | 65° C.; 1xSSC -or- 42° C.; 1xSSC, 50% formamide | 65° C.; 0.3xSSC |
| B | DNA:DNA | <50 | $T_B$; 1xSSC | $T_B$; 1xSSC |
| C | DNA:RNA | >50 | 67° C.; 1xSSC -or- 45° C.; 1xSSC, 50% formamide | 67° C.; 0.3xSSC |
| D | DNA:RNA | <50 | $T_D$; 1xSSC | $T_D$; 1xSSC |
| E | RNA:RNA | >50 | 70° C.; 1xSSC -or- 50° C.; 1xSSC, 50% formamide | 70° C.; 0.3xSSC |
| F | RNA:RNA | <50 | $T_F$; 1xSSC | $T_F$; 1xSSC |
| G | DNA:DNA | >50 | 65° C.; 4xSSC -or- 42° C.; 4xSSC, 50% formamide | 65° C.; 1xSSC |
| H | DNA:DNA | <50 | $T_H$; 4xSSC | $T_H$; 4xSSC |
| I | DNA:RNA | >50 | 67° C.; 4xSSC -or- 45° C.; 4xSSC, 50% formamide | 67° C.; 1xSSC |
| J | DNA:RNA | <50 | $T_J$; 4xSSC | $T_J$; 4xSSC |
| K | RNA:RNA | >50 | 70° C.; 4xSSC -or- 50° C.; 4xSSC, 50% formamide | 67° C.; 1xSSC |
| L | RNA:RNA | <50 | $T_L$; 2xSSC | $T_L$; 2xSSC |
| M | DNA:DNA | >50 | 50° C.; 4xSSC -or- 40° C.; 6xSSC, 50% formamide | 50° C.; 2xSSC |
| N | DNA:DNA | <50 | $T_N$; 6xSSC | $T_N$; 6xSSC |

TABLE 15-continued

Stringency Conditions

| Stringency Condition | Poly- nucleotide Hybrid | Hybrid Length (bp)$^I$ | Hybridization Temperature and Buffer$^H$ | Wash Temperature and Buffer$^H$ |
|---|---|---|---|---|
| O | DNA:RNA | >50 | 55° C.; 4xSSC -or- 42° C.; 6xSSC, 50% formamide | 55° C.; 2xSSC |
| P | DNA:RNA | <50 | $T_P$; 6xSSC | $T_P$; 6xSSC |
| Q | RNA:RNA | >50 | 60° C.; 4xSSC -or- 45° C.; 6xSSC, 50% formamide | 60° C.; 2xSSC |
| R | RNA:RNA | <50 | $T_R$; 4xSSC | $T_R$; 4xSSC |

(bp)$^I$: The hybrid length is that anticipated for the hybridized region(s) of the hybridizing polynucleotides. When hybridizing a polynucleotide to a target polynucleotide of unknown sequence, the hybrid length is assumed to be that of the hybridizing polynucleotide. When polynucleotides of known sequence are hybridized, the hybrid length can be determined by aligning the sequences of the polynucleotides and identifying the region or regions of optimal sequence complementarity.
Buffer$^H$: SSPE (1xSSPE is 0.15 M NaCl, 10 mM NaH$_2$PO$_4$, and 1.25 mM EDTA, pH 7.4) can be substituted for SSC (1xSSC is 0.15 M NaCl and 15 mM sodium citrate) in the hybridization and wash buffers; washes are performed for 15 minutes after hybridization is complete.
$T_B$ through $T_R$: The hybridization temperature for hybrids anticipated to be less than 50 base pairs in length should be 5-10° C. less than the melting temperature ($T_m$) of the hybrid, where $T_m$ is determined according to the following equations. For hybrids less than 18 base pairs in length, $T_m$(° C.) = 2(# of A + T bases) + 4(# of G + C bases). For hybrids between 18 and 49 base pairs in length, $T_m$(° C.) = 81.5 + 16.6 (log$_{10}$[Na$^+$]) + 0.41(% G + C) − (600/N), where N is the number of bases in the hybrid, and [Na$^+$] is the concentration of sodium ions in the hybridization buffer ([Na$^+$] for 1xSSC = 0.165 M).

Additional examples of stringency conditions for polynucleotide hybridization are provided in Sambrook et al., 1989, Molecular Cloning: A Laboratory Manual, Cold Spring Harbor Laboratory Press, Cold Spring Harbor, N.Y., chapters 9 and 11, and Ausubel et al., 1995, Current Protocols in Molecular Biology, eds., John Wiley & Sons, Inc., sections 2.10 and 6.3-6.4, incorporated hereinafter by reference.

In addition to the nucleic acid molecules encoding *Streptococcus pneumoniae* polypeptides described above, another aspect of the invention pertains to isolated nucleic acid molecules which are antisense thereto. An "antisense" nucleic acid comprises a nucleotide sequence which is complementary to a "sense" nucleic acid encoding a protein, e.g., complementary to the coding strand of a double-stranded cDNA molecule or complementary to an mRNA sequence. Accordingly, an antisense nucleic acid can hydrogen bond to a sense nucleic acid. The antisense nucleic acid can be complementary to an entire *Streptococcus pneumoniae* coding strand, or to only a fragment thereof. In one embodiment, an antisense nucleic acid molecule is antisense to a "coding region" of the coding strand of a nucleotide sequence encoding a *Streptococcus pneumoniae* polypeptide.

The term "coding region" refers to the region of the nucleotide sequence comprising codons which are translated into amino acid residues, e.g., the entire coding region of one of SEQ ID NO:1 through SEQ ID NO:215 or SEQ ID NO: 431 through SEQ ID NO: 591. In another embodiment, the antisense nucleic acid molecule is antisense to a "noncoding region" of the coding strand of a nucleotide sequence encoding a *Streptococcus pneumoniae* polypeptide. The term "noncoding region" refers to 5' and 3' sequences that flank the coding region that are not translated into amino acids (i.e., also referred to as 5' and 3' untranslated regions).

Given the coding strand sequence encoding the *Streptococcus pneumoniae* polypeptide disclosed hereinafter (e.g., one of SEQ ID NO:1 through SEQ ID NO:215 or SEQ ID NO: 431 through SEQ ID NO: 571), antisense nucleic acids of the invention can be designed according to the rules of Watson and Crick base pairing. The antisense nucleic acid molecule can be complementary to the entire coding region of *Streptococcus pneumoniae* mRNA, but more preferably is an oligonucleotide which is antisense to only a fragment of the coding or noncoding region of *Streptococcus pneumoniae* mRNA. For example, the antisense oligonucleotide can be complementary to the region surrounding the translation start site of *Streptococcus pneumoniae* mRNA.

An antisense oligonucleotide can be, for example, about 5, 10, 15, 20, 25, 30, 35, 40, 45 or 50 nucleotides in length. An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of th duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, I-methylguanine, I-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxasine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine.

Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a subject or generated in situ such that they hybridize with or bind to cellular mRNA and/or genomic DNA encoding a *Streptococcus pneumoniae* polypeptide to thereby inhibit expression of the polypeptide, e.g., by inhibiting transcription and/or translation. The hybridization can be by conventional nucleotide complementarity to form a stable duplex, or, for example, in the case of an antisense nucleic add molecule which binds to DNA duplexes, through specific interactions in the major groove of the double helix. An example of a route of administration of an antisense nucleic acid molecule of the invention includes direct injection at a tissue site. Alternatively, an antisense nucleic acid molecule can be modified to target selected cells and then administered systemically. For example, for systemic administration, an antisense molecule can be modified such that it specifically binds to a receptor or an antigen xpressed on a selected cell surface, e.g., by linking the antisense nucleic acid molecule to a peptide or an antibody which binds to a cell surface receptor or antigen. The antisense nucleic acid molecule can also be delivered to cells using the vectors described hereinafter.

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual γ-units, the strands run parallel to each other (Gaultier et al., 1987). The antisense nucleic acid molecule can also comprise a 2'-o-methylribonucleotide (Inoue et al., 1987 (a)) or a chimeric RNA-DNA analogue (Inoue et al., 1987(b)).

In still another embodiment, an antisense nucleic acid of the invention is a ribozyme. Ribozymes are catalytic RNA molecules with ribonuclease activity which are capable of cleaving a single-stranded nucleic acid, such as an mRNA, to which they have a complementary region. Thus, ribozymes (e.g., hammerhead ribozymes (described in Haselhoff and Gerlach, 1988)) can be used to catalytically cleave *Streptococcus pneumoniae* mRNA transcripts to thereby inhibit translation of *Streptococcus pneumoniae* mRNA. A ribozyme having specificity for a *Streptococcus pneumoniae*-encoding nucleic acid can be designed based upon the nucleotide sequence of a *Streptococcus pneumoniae* cDNA disclosed hereinafter (i.e., SEQ ID NO:I through SEQ ID NO:215 or SEQ ID NO: 431 through SEQ ID NO: 591). For example, a derivative of a Tetrahymena L-19 IVS RNA can be constructed in which the nucleotide sequence of the active site is complementary to the nucleotide sequence to be cleaved in a *Streptococcus pneumoniae*-encoding mRNA. See, e.g., Cech et al. U.S. Pat. No. 4,987,071 and Cech et al. U.S. Pat. No. 5,116,742 both incorporated by reference. Alternatively, *Streptococcus pneumoniae* mRNA can be used to select a catalytic RNA having a specific ribonuclease activity from a pool of RNA molecules. See, e.g., Bartel and Szostak, 1993.

Alternatively *Streptococcus pneumoniae* gene expression can be inhibited by targeting nucleotide sequences complementary to the regulatory region of the *Streptococcus pneumoniae* gene (e.g., the *Streptococcus pneumoniae* gene promoter and/or enhancers) to form triple helical structures that prevent transcription of the *Streptococcus pneumoniae* gene in target cells. See generally, Helene, 1991; Helene et al., 1992; and Maher, 1992.

*Streptococcus pneumoniae* gene expression can also be inhibited using RNA interference (RNAi). This is a technique for post-transcriptional gene silencing (PTGS), in which target gene activity is specifically abolished with cognate double-stranded RNA (dsRNA). RNAi resembles in many aspects PTGS in plants and has been detected in many invertebrates including trypanosome, hydra, planaria, nematode and fruit fly (*Drosophila melangnoster*). It may be involved in the modulation of transposable element mobilization and antiviral state formation. RNAi in mammalian systems is disclosed in International Application WO 00/63364 which is incorporated by reference hereinafter in its entirety. Basically, dsRNA of at least about 600 nucleotides, homologous to the target is introduced into the cell and a sequence specific reduction in gene activity is observed.

C. *Streptococcus Pneumoniae* Polypeptides

In particular embodiments, the present invention provides isolated and purified *Streptococcus pneumoniae* polypeptides. Preferably, a *Streptococcus pneumoniae* polypeptide of the invention is a recombinant polypeptide. In certain embodiments, a *Streptococcus pneumoniae* polypeptide of the present invention comprises the amino acid sequence that has at least 95% identity to the amino acid sequence of one of SEQ ID NO:216 through SEQ ID NO:430 or SEQ ID NO: 592 through SEQ ID NO: 752 a biological equivalent thereof, or a fragment thereof.

A *Streptococcus pneumoniae* polypeptide according to the present invention encompasses a polypeptide that comprises: 1) the amino acid sequence shown in one of SEQ ID NO:216 through SEQ ID NO:430 or SEQ ID NO: 592 or SEQ ID NO: 752; 2) functional and non-functional naturally occurring variants or biological equivalents of *Streptococcus pneumoniae* polypeptides of SEQ ID NO:216 through SEQ ID NO:430 or SEQ ID NO: 592 through 752; 3) recombinantly produced variants or biological equivalents of *Streptococcus pneumoniae* polypeptides of SEQ ID NO:216 through SEQ ID NO:430 or SEQ ID NO: 592 through SEQ ID NO: 752; and 4) polypeptides isolated from organisms other than *Streptococcus pneumoniae* (orthologues of *Streptococcus pneumoniae* polypeptides.)

A biological equivalent or variant of a *Streptococcus pneumoniae* polypeptide according to the present invention encompasses 1) a polypeptide isolated from *Streptococcus pneumoniae*; and 2) a polypeptide that contains substantially homology to a *Streptococcus pneumoniae* polypeptide.

Biological equivalents or variants of *Streptococcus pneumoniae* include both functional and non-functional *Streptococcus pneumoniae* polypeptides. Functional biological equivalents or variants are naturally occurring amino acid sequence variants of a *Streptococcus pneumoniae* polypeptide that maintains the ability to elicit an immunological or antigenic response in a subject. Functional variants will typically contain only conservative substitution of one or more amino acids of one of SEQ ID NO:216 through SEQ ID NO:430 or SEQ ID NO: 592 through SEQ ID NO: 752, or substitution, deletion or insertion of non-critical residues in non-critical regions of the polypeptide (e.g., not in regions containing antigenic determinants or protective epitopes).

The present invention further provides non-*Streptococcus pneumoniae* orthologues of *Streptococcus pneumoniae* polypeptides. Orthologues of *Streptococcus pneumoniae* polypeptides are polypeptides that are isolated from non-*Streptococcus pneumoniae* organisms and possess antigenic capabilities of the *Streptococcus pneumoniae* polypeptide. Orthologues of a *Streptococcus pneumoniae* polypeptide can readily be identified as comprising an amino acid sequence that is substantially homologous to one of SEQ ID NO:216 through SEQ ID NO:430 or SEQ ID NO: 592 through SEQ ID NO: 752.

Modifications and changes can be made in the structure of a polypeptide of the present invention and still obtain a molecule having *Streptococcus pneumoniae* antigenicity. For example, certain amino acids can be substituted for other amino acids in a sequence without appreciable loss of antigenicity. Because it is the interactive capacity and nature of a polypeptide that defines that polypeptide's biological functional activity, certain amino acid sequence substitutions can be made in a polypeptide sequence (or, of course, its underlying DNA coding sequence) and nevertheless obtain a polypeptide with like properties.

In making such changes, the hydropathic index of amino acids can be considered. The importance of the hydropathic amino acid index in conferring interactive biologic function on a polypeptide is generally understood in the art (Kyte & Doolittle, 1982). It is known that certain amino acids can be substituted for other amino acids having a similar hydropathic index or score and still result in a polypeptide with similar biological activity. Each amino acid has been assigned a hydropathic index on the basis of its hydrophobicity and charge characteristics. Those indices are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

It is believed that the relative hydropathic character of the amino acid residue determines the secondary and tertiary structure of the resultant polypeptide, which in turn defines the interaction of the polypeptide with other molecules, such as enzymes, substrates, receptors, antibodies, antigens, and the like. It is known in the art that an amino acid can be substituted by another amino acid having a similar hydropathic index and still obtain a functionally equivalent polypeptide. In such changes, the substitution of amino acids whose hydropathic indices are within +/−2 is preferred, those that are within +/−1 are particularly preferred, and those within +/−0.5 are even more particularly preferred.

Substitution of like amino acids can also be made on the basis of hydrophilicity, particularly where the biological functional equivalent polypeptide or peptide thereby created is intended for use in immunological embodiments. U.S. Pat. No. 4,554,101, incorporated hereinafter by reference, states that the greatest local average hydrophilicity of a polypeptide, as governed by the hydrophilicity of its adjacent amino acids, correlates with its immunogenicity and antigenicity, i.e. with a biological property of the polypeptide.

As detailed in U.S. Pat. No. 4,554,101, the following hydrophilicity values have been assigned to amino acid residues: arginine (+3.0); lysine (+3.0); aspartate (+3.0±1); glutamate (+3.0±1); serine (+0.3); asparagine (+0.2); glutamine (+0.2); glycine (0); proline (−0.5±1); threonine (−0.4); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4). It is understood that an amino acid can be substituted for another having a similar hydrophilicity value and still obtain a biologically equivalent, and in particular, an immunologically equivalent polypeptide. In such changes, the substitution of amino acids whos hydrophilicity values are within ±2 is preferred, those that are within ±1 are particularly preferred, and those within ±0.5 are even more particularly preferred.

As outlined above, amino acid substitutions are generally therefore based on the relative similarity of the amino acid side-chain substituents, for example, their hydrophobicity, hydrophilicity, charge, size, and the like. Exemplary substitutions which take various of the foregoing characteristics into consideration are well known to those of skill in the art and include: arginine and lysine; glutamate and aspartate; serine and threonine; glutamine and asparagine; and valine, leucine and isoleucine (See Table 16, below). The present invention thus contemplates functional or biological equivalents of a *Streptococcus pneumoniae* polypeptide as set forth above.

TABLE 16

Amino Acid Substitutions

| Original Residue | Exemplary Residue Substitution |
|---|---|
| Ala | Gly; Ser |
| Arg | Lys |
| Asn | Gln; His |
| Asp | Glu |
| Cys | Ser |
| Gln | Asn |
| Glu | Asp |

TABLE 16-continued

Amino Acid Substitutions

| Original Residue | Exemplary Residue Substitution |
|---|---|
| Gly | Ala |
| His | Asn; Gln |
| Ile | Leu; Val |
| Leu | Ile; Val |
| Lys | Arg |
| Met | Leu; Tyr |
| Ser | Thr |
| Thr | Ser |
| Trp | Tyr |
| Tyr | Trp; Phe |
| Val | Ile; Leu |

Biological or functional equivalents of a polypeptide can also be prepared using site-specific mutagenesis. Site-specific mutagenesis is a technique useful in the preparation of second generation polypeptides, or biologically functional equivalent polypeptides or peptides, derived from the sequences thereof, through specific mutagenesis of the underlying DNA. As noted above, such changes can be desirable where amino acid substitutions are desirable. The technique further provides a ready ability to prepare and test sequence variants, for example, incorporating one or more of the foregoing considerations, by introducing one or more nucleotide sequence changes into the DNA. Site-specific mutagenesis allows the production of mutants through the use of specific oligonucleotide sequences which encode the DNA sequence of the desired mutation, as well as a sufficient number of adjacent nucleotides, to provide a primer sequence of sufficient size and sequence complexity to form a stable duplex on both sides of the deletion junction being traversed. Typically, a primer of about 17 to 25 nucleotides in length is preferred, with about 5 to 10 residues on both sides of the junction of the sequence being altered.

In general, the technique of site-specific mutagenesis is well known in the art. As will be appreciated, the technique typically employs a phage vector which can exist in both a single stranded and double stranded form. Typically, site-directed mutagenesis in accordance herewith is performed by first obtaining a single-stranded vector which includes within its sequence a DNA sequence which encodes all or a portion of the *Streptococcus pneumoniae* polypeptide sequence selected. An oligonucleotide primer bearing the desired mutated sequence is prepared (e.g., synthetically). This primer is then annealed to the singled-stranded vector, and extended by the use of enzymes such as *E. coli* polymerase I Klenow fragment, in order to complete the synthesis of the mutation-bearing strand. Thus, a heteroduplex is formed wherein one strand encodes the original non-mutated sequence and the second strand bears the desired mutation. This heteroduplex vector is then used to transform appropriate cells such as *E. coli* cells and clones are selected which include recombinant vectors bearing the mutation. Commercially available kits come with all the reagents necessary, except the oligonucleotide primers.

A *Streptococcus pneumoniae* polypeptide or polypeptide antigen of the present invention is understood to be any *Streptococcus pneumoniae* polypeptide comprising substantial sequence similarity, structural similarity and/or functional similarity to a *Streptococcus pneumoniae* polypeptide comprising the amino acid sequence of one of SEQ ID NO:216 through SEQ ID NO:430 or SEQ ID NO: 592 through SEQ ID NO: 752. In addition, a *Streptococcus pneumoniae* polypeptide or polypeptide antigen of the invention is not limited to a particular source. Thus, the invention provides for the general detection and isolation of the polypeptides from a variety of sources.

It is contemplated in the present invention, that a *Streptococcus pneumoniae* polypeptide may advantageously be cleaved into fragments for use in further structural or functional analysis, or in the generation of reagents such as *Streptococcus pneumoniae*-related polypeptides and *Streptococcus pneumoniae*-specific antibodies. This can be accomplished by treating purified or unpurified *Streptococcus pneumoniae* polypeptides with a peptidase such as endoproteinase glu-C (Boehringer, Indianapolis, Ind.). Treatment with CNBr is another method by which peptide fragments may be produced from natural *Streptococcus pneumoniae* polypeptides. Recombinant techniques also can be used to produce specific fragments of a *Streptococcus pneumoniae* polypeptide.

In addition, the inventors also contemplate that compounds sterically similar to a particular *Streptococcus pneumoniae* polypeptide antigen may be formulated to mimic the key portions of the peptide structure, called peptidomimetics. Mimetics are peptide-containing molecules which mimic elements of protein secondary structure. (see, e.g. Johnson et al., 1993). The underlying rationale behind the use of peptide mimetics is that the peptide backbone of proteins exists chiefly to orient amino acid side chains in such a way as to facilitate molecular interactions, such as those of receptor and ligand.

Successful applications of the peptide mimetic concept have thus far focused on mimetics of β-turns within proteins. Likely β-turn structures within *Streptococcus pneumoniae* can be predicted by computer-based algorithms as discussed above. Once the component amino acids of the turn are determined, mimetics can be constructed to achieve a similar spatial orientation of the essential elements of the amino acid side chains, as discussed in Johnson et al., 1993.

Fragments of the *Streptococcus pneumoniae* polypeptides are also included in the invention. A fragment is a polypeptide having an amino acid sequence that entirely is the same as part, but not all, of the amino acid sequence. The fragment can comprise, for example, at least 7 or more (e.g., 8, 10, 12, 14, 16, 18, 20, or more) contiguous amino acids of an amino acid sequence of one of SEQ ID NO: 216 through SEQ ID NO: 430 or SEQ ID NO:592 through SEQ ID NO: 752. Fragments may be "freestanding" or comprised within a larger polypeptide of which they form a part or region, most preferably as a single, continuous region. In one embodiment, the fragments include at least one epitope of the mature polypeptide sequence.

"Fusion protein" refers to a protein or polypeptide encoded by two, often unrelated, fused genes or fragments thereof. For example, fusion proteins or polypeptides comprising various portions of constant region of immunoglobulin molecules together with another human protein or part thereof have been described. In many cases, employing an immunoglobulin Fc region as a part of a fusion protein or polypeptide is advantageous for use in therapy and diagnosis resulting in, for example, improved pharmacokinetic properties (see e.g., International Application EP-A 0232 2621). On the other hand, for some uses it would be desirable to be able to delete the Fc part after the fusion protein or polypeptide has been expressed, detected and purified.

D. *Streptococcus Pneumoniae* Polynucleotide and Polypeptide Variants

"Variant" as the term is used hereinafter, is a polynucleotide or polypeptide that differs from a reference polynucleotide or polypeptide respectively, but retains essential properties. A typical variant of a polynucleotide differs in nucleotide sequence from another, reference polynucleotide. Changes in the nucleotide sequence of the variant may or may not alter the amino acid sequence of a polypeptide encoded by the reference polynucleotide. Nucleotide changes may result in amino acid substitutions, additions, deletions, fusions and truncations in the polypeptide encoded by the reference sequence, as discussed below. A typical variant of a polypeptide differs in amino acid sequence from another, reference polypeptide. Generally, differences are limited so that the sequences of the reference polypeptide and the variant are closely similar overall and, in many regions, identical. A variant and reference polypeptide may differ in amino acid sequence by one or more substitutions, additions, deletions in any combination. A substituted or inserted amino acid residue may or may not be one encoded by the genetic code. A variant of a polynucleotide or polypeptide may be a naturally occurring such as an allelic variant, or it may be a variant that is not known to occur naturally. Non-naturally occurring variants of polynucleotides and polypeptides may be made by mutagenesis techniques or by direct synth sis.

"Identity," as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those described in (Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991; and Carillo, H., and Lipman, D., SIAM J. Applied Math., 48: 1073 (1988). Preferred methods to determine identity are designed to give the largest match between the sequences tested. Methods to determine identity and similarity are codified in publicly available computer programs. Preferred computer program methods to determine identity and similarity between two sequences include, but are not limited to, the GCG program package (Devereux, J., et al 1984), BLASTP, BLASTN, TBLASTN and FASTA (Altschul, S. F., et al., 1990). The BLASTX program is publicly available from NCBI and other sources (BLAST Manual, Altschul, S., et al., NCBI NLM NIH Bethesda, Md. 20894; Altschul, S., et al., 1990). The well known Smith-Waterman algorithm may also be used to determine identity.

By way of example, a polynucleotide sequence of the present invention may be identical to the reference sequence of one of SEQ ID NO:1 through SEQ ID NO:215 or SEQ ID NO: 431 through SEQ ID NO: 591, that is be 100% identical, or it may include up to a certain integer number of nucleotide alterations as compared to the reference sequence. Such alterations are selected from the group consisting of at least one nucleotide deletion, substitution, including transition and transversion, or insertion, and wherein said alterations may occur at the 5' or 3' terminal positions of the reference nucleotide sequence or anywhere between those terminal positions, interspersed either individually among the nucleotides in the reference sequence or in one or more contiguous groups within the reference sequence. The number of nucleotide alterations is determined by multiplying the total number of nucleotides in one of SEQ ID NO:1 through SEQ ID NO:215 or SEQ ID NO: 431 through SEQ ID NO: 591 by the numerical percent of the respective percent identity (divided by 100) and subtracting that product from said total number of nucleotides in one of SEQ ID NO:1 through SEQ ID NO:215 or SEQ ID NO: 431 through SEQ ID NO: 591.

For example, an isolated *Streptococcus pneumoniae* polynucleotide comprising a polynucleotide sequence that has at least 70% identity to the nucleic acid sequence of one of SEQ ID NO:1 through SEQ ID NO:215 or SEQ ID NO: 431 through SEQ ID NO: 591; a degenerate variant thereof or a fragment thereof, wherein the polynucleotide sequence may include up to $n_n$ nucleic acid alterations over the entire polynucleotide region of the nucleic acid sequence of one of SEQ ID NO:1 through SEQ ID NO:215 or SEQ ID NO: 431 through SEQ ID NO: 591, wherein $n_n$ is the maximum number of alterations and is calculated by the formula:

$$n_n \leq x_n - (x_n \cdot y),$$

in which $x_n$ is the total number of nucleic acids of one of SEQ ID NO:1 through SEQ ID NO:215 or SEQ ID NO: 431 through SEQ ID NO: 591 and y has a value of 0.70, wherein any non-integer product of $x_n$ and y is rounded down to the nearest integer prior to subtracting such product from $x_n$. Of course, y may also have a value of 0.80 for 80%, 0.85 for 85%, 0.90 for 90% 0.95 for 95%, etc. Alterations of a polynucleotide sequence encoding one of the polypeptides of SEQ ID NO:216 through SEQ ID NO:430 or SEQ ID NO: 592 through SEQ ID NO: 752 may create nonsense, missense or frameshift mutations in this coding sequence and thereby alter the polypeptide encoded by the polynucleotide following such alterations.

Similarly, a polypeptide sequence of the present invention may be identical to the reference sequence of SEQ ID NO:216 through SEQ ID NO:430 or SEQ ID NO: 592 through SEQ ID NO: 752, that is be 100% identical, or it may include up to a certain integer number of amino acid alterations as compared to the reference sequence such that the % identity is less than 100%. Such alterations are selected from the group consisting of at least one amino acid deletion, substitution, including conservative and non-conservative substitution, or insertion, and wherein said alterations may occur at the amino- or carboxy-terminal positions of the reference polypeptide sequence or anywhere between those terminal positions, interspersed either individually among the amino acids in the reference sequence or in one or more contiguous groups within the reference sequence. The number of amino acid alterations for a given % identity is determined by multiplying the total number of amino acids in one of SEQ ID NO:216 through SEQ ID NO:430 or SEQ ID NO: 592 through SEQ ID NO: 752 by the numerical percent of the respective percent identity (divided by 100) and then subtracting that product from said total number of amino acids in one of SEQ ID NO:216 through SEQ ID NO:430 or SEQ ID NO: 592 through SEQ ID NO: 752, or:

$$n_a \leq x_a - (x_a \cdot y),$$

wherein $n_a$ is the number of amino acid alterations, $x_a$ is the total number of amino acids in one of SEQ ID NO:216 through SEQ ID NO:430 SEQ ID NO: 592 through SEQ ID NO: 752, and y is, for instance 0.70 for 70%, 0.80 for 80%, 0.85 for 85% etc., and wherein any non-integer product of $x_a$ and y is rounded down to the nearest integer prior to subtracting it from $x_a$.

E. Vectors, Host Cells and Recombinant *Streptococcus Pneumoniae* Polypeptides

In a preferred embodiment, the present invention provides expression vectors comprising ORF polynucleotides that encode *Streptococcus pneumoniae* polypeptides. Preferably, the expression vectors of the present invention comprise ORF polynucleotides that encode *Streptococcus pneumoniae* polypeptides comprising the amino acid residue sequence of one of SEQ ID NO:216 through SEQ ID NO:430 or SEQ ID NO: 592 through SEQ ID NO: 752. More preferably, the expression vectors of the present invention comprise a polynucleotide comprising the nucleotide base sequence of one of SEQ ID NO:1 through SEQ ID NO:215 or SEQ ID NO: 431 through SEQ ID NO: 591. Even more preferably, the expression vectors of the invention comprise a polynucleotide operatively linked to an enhancer-promoter. More preferably still, the expression vectors of the invention comprise polynucleotide operatively linked to a prokaryotic promoter. Alternatively, the expression vectors of the present invention comprise polynucleotide operatively linked to an enhancer-promoter that is a eukaryotic promoter, and the expression vectors further comprise a polyadenylation signal that is positioned 3' of the carboxy-terminal amino acid and within a transcriptional unit of the encoded polypeptide.

Expression of proteins in prokaryotes is most often carried out in *E. coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase.

Typical fusion expression vectors include pGEX (Pharmacia Biotech Inc; Smith and Johnson,1988), pMAL (New England Biolabs, Beverly; Mass.) and pRIT5 (Pharmacia, Piscataway, N.J.) which fuse glutathione S-transferase (GST), maltose E binding protein, or protein A, respectively, to the target recombinant protein.

In one embodiment, the coding sequence of the *Streptococcus pneumoniae* polynucleotide is cloned into a pGEX expression vector to create a vector encoding a fusion protein comprising, from the N-terminus to the C-terminus, GST-thrombin cleavage site-*Streptococcus pneumoniae* polypeptide. The fusion protein can be purified by affinity chromatography using glutathione-agarose resin. Recombinant *Streptococcus pneumoniae* polypeptide unfused to GST can be recovered by cleavage of the fusion protein with thrombin.

Examples of suitable inducible non-fusion *E. coli* expression vectors include pTrc (Amann et al., 1988), pET Ild (Studier et al., 1990), pBAD and pCRT7. Target gene expression from the pTrc vector relies on host RNA polymerase transcription from a hybrid trp-lac fusion promoter. Target gene expression from the pET Ild vector relies on transcription from a T7 gnl 0-lac fusion promoter mediated by a coexpressed viral RNA polymerase J7 gnl. This viral polymerase is supplied by host strains BL21 (DE3) or HMS I 74(DE3) from a resident prophage harboring a T7 gnl gene under the transcriptional control of the lacUV 5 promoter.

One strategy to maximize recombinant protein expression in *E. coli* is to express the protein in a host bacterium with an impaired capacity to proteolytically cleave the recombinant protein. Another strategy is to alter the nucleic acid sequence of the nucleic acid to be inserted into an expression vector so that the individual codons for each amino acid are those preferentially utilized in *E. coli*. Such alteration of nucleic acid sequences of the invention can be carried out by standard DNA mutagenesis or synthesis techniques.

In another embodiment, the *Streptococcus pneumoniae* polynucleotide expression vector is a yeast expression vector. Examples of vectors for expression in yeast *S. cerivisae* include pYepSec I (Baldari, et al., 1987), pMFa (Kurjan and Herskowitz, 1982), pJRY88 (Schultz et al., 1987), and pYES2 (Invitrogen Corporation, San Diego, Calif.).

Alternatively, a *Streptococcus pneumoniae* polynucleotide can be expressed in insect cells using, for example, baculovirus expression vectors. Baculovirus vectors available for expression of proteins in cultured insect cells (e.g., Sf 9 cells) include the pAc series (Smith et al, 1983) and the pVL series (Lucklow and Summers, 1989).

In yet another embodiment, a nucleic acid of the invention is expressed in mammalian cells using a mammalian expression vector. Examples of mammalian expression vectors include pCDM8 (Seed, 1987) and pMT2PC (Kaufman et al., 1987). When used in mammalian cells, the expression vector's control functions are often provided by viral regulatory elements.

As used hereinafter, a promoter is a region of a DNA molecule typically within about 100 nucleotide pairs in front of (upstream of) the point at which transcription begins (i.e., a transcription start site). That region typically contains several types of DNA sequence elements that are located in similar relative positions in different genes. As used hereinafter, the term "promoter" includes what is referred to in the art as an upstream promoter region, a promoter region or a promoter of a generalized eukaryotic RNA Polymerase II transcription unit.

Another type of discrete transcription regulatory sequence element is an enhancer. An enhancer provides specificity of time, location and expression level for a particular encoding region (e.g., gene). A major function of an enhancer is to increase the level of transcription of a coding sequence in a cell that contains one or more transcription factors that bind to that enhancer. Unlike a promoter, an enhancer can function when located at variable distances from transcription start sites so long as a promoter is present.

As used hereinafter, the phrase "enhancer-promote" means a composite unit that contains both enhancer and promoter elements. An enhancer-promoter is operatively linked to a coding sequence that encodes at least one gene product. As used hereinafter, the phrase "operatively linked" means that an enhancer-promoter is connected to a coding sequence in such a way that the transcription of that coding sequence is controlled and regulated by that enhancer-promoter. Means for operatively linking an enhancer-promoter to a coding sequence are well known in the art. As is also well known in the art, the precise orientation and location relative to a coding sequence whose transcription is controlled, is dependent inter alia upon the specific nature of the enhancer-promoter. Thus, a TATA box minimal promoter is typically located from about 25 to about 30 base pairs upstream of a transcription initiation site and an upstream promoter element is typically located from about 100 to about 200 base pairs upstream of a transcription initiation site. In contrast, an enhancer can be located downstream from the initiation site and can be at a considerable distance from that site.

An enhancer-promoter used in a vector construct of the present invention can be any enhancer-promoter that drives expression in a cell to be transfected. By employing an enhancer-promoter with well-known properties, the level and pattern of gene product expression can be optimized.

For example, commonly used promoters are derived from polyoma, Adenovirus 2, cytomegalovirus and Simian Virus 40. For other suitable expression systems for both prokaryotic and eukaryotic cells see chapters 16 and 17 of Sambrook et al., "Molecular Cloning: A Laboratory Manual" 2nd, ed, Cold Spring Harbor Laboratory, Cold Spring Harbor Laboratory Press, Cold Spring Harbor, N.Y., 1989, incorporated hereinafter by reference.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert et al., 1987), lymphoid-specific promoters (Calame and Eaton, 1988), in particular, promoters of T cell receptors (Winoto and Baltimore, 1989) and immunoglobulins (Banerji et al., 1983), Queen and Baltimore (1983), neuron-specific promoters (e.g., the neurofilament promoter; Byrne and Ruddle, 1989), pancreas-specific promoters (Edlund et al., 1985), and mammary gland-specific promoters (e.g., milk whey promoter; U.S. Pat. No. 4,873,316 and International Application EP 264,166). Developmentally-regulated promoters are also encompassed, for example the murine hox promoters (Kessel and Gruss, 1990) and the α-fetoprotein promoter (Campes and Tilghman, 1989).

The invention further provides a recombinant expression vector comprising a DNA molecule encoding a *Streptococcus pneumoniae* polypeptide cloned into the expression vector in an antisense orientation. That is, the DNA molecule is operatively linked to a regulatory sequence in a manner which allows for expression (by transcription of the DNA molecule) of an RNA molecule which is antisense to *Streptococcus pneumoniae* mRNA. Regulatory sequences operatively linked to a nucleic acid cloned in the antisense orientation can be chosen which direct the continuous expression of the antisense RNA molecule in a variety of cell types. For instance viral promoters and/or enhancers, or regulatory sequences can be chosen which direct constitutive, tissue specific or cell type specific expression of antisense RNA. The antisense expression vector can be in the form of a recombinant plasmid, phagemid or attenuated virus in which antisense nucleic acids are produced under the control of a high efficiency regulatory region, the activity of which can be determined by the cell type into which the vector is introduced.

Another aspect of the invention pertains to host cells into which a recombinant expression vector of the invention has been introduced. The terms "host cell" and "recombinant host cell" are used interchangeably hereinafter. It is understood that such terms refer not only to the particular subject cell, but to the progeny or potential progeny of such a cell. Because certain modifications may occur in succeeding generations due to either mutation or environmental influences, such progeny may not, in fact, be identical to the parent cell, but are still included within the scope of the term as used hereinafter. A host cell can be any prokaryotic or eukaryotic cell. For example, a *Streptococcus pneumoniae* polypeptide can be expressed in bacterial cells such as *E. coli*, insect cells (such as Sf9, Sf21), yeast or mammalian cells (such as Chinese hamster ovary cells (CHO), VERO, chick embryo fibroblasts, BHK cells or COS cells). Other suitable host cells are known to those skilled in the art.

Vector DNA is introduced into prokaryotic or eukaryotic cells via conventional transformation, infection or transfection techniques. As used hereinafter, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, ultrasound or electroporation. Suitable methods for transforming or transfecting host cells can be found in Sambrook, et al. ("Molecular Cloning: A Laboratory Manual" 2nd, ed, Cold Spring Harbor Laboratory, Cold Spring Harbor Laboratory Press, Cold Spring Harbor, N.Y., 1989), and other laboratory manuals.

A host cell of the invention, such as a prokaryotic or eukaryotic host cell in culture, can be used to produce (i.e., express) a *Streptococcus pneumoniae* polypeptide. Accordingly, the invention further provides methods for producing a *Streptococcus pneumoniae* polypeptide using the host cells of the invention. In one embodiment, the method comprises culturing the host cell of invention (into which a recombinant expression vector encoding a *Streptococcus pneumoniae* polypeptide has been introduced) in a suitable medium until the *Streptococcus pneumoniae* polypeptide is produced. In another embodiment, the method further comprises isolating the *Streptococcus pneumoniae* polypeptide from the medium or the host cell.

A coding sequence of an expression vector is operatively linked to a transcription termination region. RNA polymerase transcribes an encoding DNA sequence through a site where polyadenylation occurs. Typically, DNA sequences located a few hundred base pairs downstream of the polyadenylation site serve to terminate transcription. Those DNA sequences are referred to hereinafter as transcription-termination regions. Those regions are required for efficient polyadenylation of transcribed messenger RNA (mRNA). Transcription-termination regions are well known in the art. A preferred transcription-termination region used in an adenovirus vector construct of the present invention comprises a polyadenylation signal of SV40 or the protamine gene.

An expression vector comprises a polynucleotide that encodes a *Streptococcus pneumoniae* polypeptide. Such a polypeptide is meant to include a sequence of nucleotide bases encoding a *Streptococcus pneumoniae* polypeptide sufficient in length to distinguish the segment from a polynucleotide segment encoding a non-*Streptococcus pneumoniae* polypeptide. A polypeptide of the invention can also encode biologically functional polypeptides or peptides which have variant amino acid sequences, such as with changes selected based on considerations such as the relative hydropathic score of the amino acids being exchanged. These variant sequences are those isolated from natural sources or induced in the sequences disclosed hereinafter using a mutagenic procedure such as site-directed mutagenesis.

Preferably, the expression vectors of the present invention comprise polynucleotide that encode polypeptides comprising the amino acid residue sequence of one of SEQ ID NO:216 through SEQ ID NO:430 or SEQ ID NO: 592 through SEQ ID NO: 752. An expression vector can include a *Streptococcus pneumoniae* polypeptide coding region itself of any of the *Streptococcus pneumoniae* polypeptides noted above or it can contain coding regions bearing selected alterations or modifications in the basic coding region of such a *Streptococcus pneumoniae* polypeptide.

Alternatively, such vectors or fragments can code larger polypeptides or polypeptides which nevertheless include the basic coding region. In any event, it should be appreciated that due to codon redundancy as well as biological functional equivalence, this aspect of the invention is not limited to the particular DNA molecules corresponding to the polypeptide sequences noted above.

Exemplary vectors include the mammalian expression vectors of the pCMV family including pCMV6b and pCMV6c (Chiron Corp., Emeryville Calif.). In certain cases, and specifically in the case of these individual mammalian expression vectors, the resulting constructs can require co-transfection with a vector containing a selectable marker such as pSV2neo. Via co-transfection into a dihydrofolate reductase-deficient Chinese hamster ovary cell line, such as DG44, clones expressing *Streptococcus pneumoniae* polypeptides by virtue of DNA incorporated into such expression vectors can be detected.

A DNA molecule of the present invention can be incorporated into a vector by a number of techniques that are well known in the art. For instance, the vector pUC18 has been demonstrated to be of particular value in cloning and expression of genes. Likewise, the related vectors M13mp18 and M13mp19 can be used in certain embodiments of the invention, in particular, in performing dideoxy sequencing.

An expression vector of the present invention is useful both as a means for preparing quantities of the *Streptococcus pneumoniae* polypeptide-encoding DNA itself, and as a means for preparing the encoded polypeptide and peptides. It is contemplated that where *Streptococcus pneumoniae* polypeptides of the invention are made by recombinant means, one can employ either prokaryotic or eukaryotic expression vectors as shuttle systems.

In another aspect, the recombinant host cells of the present invention are prokaryotic host cells. Preferably, the recombinant host cells of the invention are bacterial cells of the DH5α strain of *Escherichia coli*. In general, prokaryotes are preferred for the initial cloning of DNA sequences and constructing the vectors useful in the invention. For example, *E. coli* K12 strains can be particularly useful. Other microbial strains that can be used include *E. coil* B, and *E. coli$_x$976* (ATCC No. 31537). These examples are, of course, intended to be illustrative rather than limiting.

The aforementioned strains, as well as *E. coli* W3110 (ATCC No. 273325), *E. coli* BL21 (DE3), *E. coli* Top10, bacilli such as *Bacillus subtilis*, or other enterobacteriaceae such as *Salmonella typhimurium* (or other attenuated *Salmonella* strains as described in U.S. Pat. No. 4,837,151) or *Serratia marcesan*, and various Pseudomonas species can be used.

In general, plasmid vectors containing replicon and control sequences, which are derived from species compatible with the host cell are used in connection with these hosts. The vector ordinarily carries a replication site, as well as marking sequences which are capable of providing phenotypic selection in transformed cells. For example, *E. coli* can be transformed using pBR322, a plasmid derived from an *E. coli* species (Bolivar, et al. 1977). pBR322 contains genes for ampicillin and tetracycline resistance and thus provides easy means for identifying transformed cells. The pBR plasmid, or other microbial plasmid or phage must also contain, or be modified to contain, promoters which can be used by the microbial organism for expression of its own polypeptides.

Those promoters most commonly used in recombinant DNA construction include the β-lactamase (penicillinase) and lactose promoter systems (Chang, et al. 1978; Itakura., et al. 1977, Goeddel, et al., 1979; Goeddel, et al. 1980) and a tryptophan (TRP) promoter system (EP 0036776; Siebwenlist et al., 1980). While these are the most commonly used, other microbial promoters have been discovered and utilized, and details concerning their nucleotide sequences have been published, enabling a skilled worker to introduce functional promoters into plasmid vectors (Siebwenlist, et al. 1980).

In addition to prokaryotes, eukaryotic microbes such as yeast can also be used. *Saccharomyces cerevisiase* or common baker's yeast is the most commonly used among eukaryotic microorganisms, although a number of other strains are commonly available. For expression in Saccharomyces, the plasmid YRp7, for example, is commonly used (Stinchcomb, et al. 1979; Kingsman, et al. 1979; Tschemper, et al. 1980). This plasmid already contains the trpl gene which provides a selection marker for a mutant strain of yeast lacking the ability to grow in tryptophan, for example ATCC No. 44076 or PEP4-1 (Jones, 1977). The presence of the trpl lesion as a characteristic of the yeast host cell genome then provides an effective environment for detecting transformation by growth in the absence of tryptophan.

Suitable promoter sequences in yeast vectors include the promoters for 3-phosphoglycerate kinase (Hitzeman., et al. 1980) or other glycolytic enzymes (Hess, et al., 1968; Holland, et al. 1978) such as enolase, glyceraldehyde-3-phosphate dehydrogenase, hexokinase, pyruvate decarboxylase, phosphofructokinase, glucose-6-phosphate isomerase, 3-phosphoglycerate mutase, pyruvate kinase, triosephosphate isomerase, phosphoglucose isomerase, and glucokinase. In constructing suitable expression plasmids, the termination sequences associated with these genes are also introduced into the expression vector downstream from the sequences to be expressed to provide polyadenylation of the mRNA and termination. Other promoters, which have the additional advantage of transcription controlled by growth conditions are the promoter region for alcohol dehydrogenase 2, isocytochrome C, acid phosphatase, degradative enzymes associated with nitrogen metabolism, and the aforementioned glyceraldehyde-3-phosphate dehydrogenase, and enzymes responsible for maltose and galactose utilization. Any plasmid vector containing a yeast-compatible promoter, origin or replication and termination sequences are suitable.

In addition to microorganisms, cultures of cells derived from multicellular organisms can also be used as hosts. In principle, any such cell culture is workable, whether from vertebrate or invertebrate culture. However, interest has been greatest in vertebrate cells, and propagation of vertebrate cells in culture (tissue culture) has become a routine procedure in recent years. Examples of such useful host cell lines are AtT-20, VERO, HeLa, NSO, PER C6, Chinese hamster ovary (CHO) cell lines, and W138, BHK, COSM6, COS-7, 293 and MDCK cell lines. Expression vectors for such cells ordinarily include (if necessary) an origin of replication, a promoter located upstream of the gene to be expressed, along with any necessary ribosome binding sites, RNA splice sites, polyadenylation site, and transcriptional terminator sequences.

Where expression of recombinant *Streptococcus pneumoniae* polypeptides is desired and a eukaryotic host is contemplated, it is most desirable to employ a vector such as a plasmid, that incorporates a eukaryotic origin of replication. Additionally, for the purposes of expression in eukaryotic systems, one desires to position the *Streptococcus pneumoniae* encoding sequence adjacent to and under the control of an effective eukaryotic promoter such as promoters used in combination with Chinese hamster ovary cells. To bring a coding sequence under control of a promoter, whether it is eukaryotic or prokaryotic, the 5' end of the translation initiations region of the proper translational reading frame of the polypeptide must be positioned between about 1 and about 50 nucleotides 3' of or downstream with respect to the promoter chosen. Furthermore, where eukaryotic expression is anticipated, one would typically desire to incorporate into the transcriptional unit which includes the *Streptococcus pneumoniae* polypeptide.

Means of transforming or transfecting cells with exogenous polynucleotide such as DNA molecules are well known in the art and include techniques such as calcium-phosphate- or DEAE-dextran-mediated transfection, protoplast fusion, electroporation, liposome mediated transfection, direct microinjection and adenovirus infection (see e.g., Sambrook, Fritsch and Maniatis, 1989).

The most widely used method is transfection mediated by either calcium phosphate or DEAE-dextran. Although the mechanism remains obscure, it is believed that the transfected DNA enters the cytoplasm of the cell by ndocytosis and is transported to the nucleus. Depending on the cell type, up to 90% of a population of cultured cells can be transfected at any one time. Because of its high efficiency, transfection mediated by calcium phosphate or DEAE-dextran is the method of choice for experiments that require transient expression of the foreign DNA in large numbers of cells. Calcium phosphate-mediated transfection is also used to establish cell lines that integrate copies of the foreign DNA, which are usually arranged in head-to-tail tandem arrays into the host cell genome.

In the protoplast fusion method, protoplasts derived from bacteria carrying high numbers of copies of a plasmid of interest are mixed directly with cultured mammalian cells. After fusion of the cell membranes (usually with polyethylene glycol), the contents of the bacteria are delivered into the cytoplasm of the mammalian cells and the plasmid DNA is transported to the nucleus. Protoplast fusion is not as efficient as transfection for many of the cell lines that are commonly used for transient expression assays, but it is useful for cell lines in which endocytosis of DNA occurs inefficiently. Protoplast fusion frequently yields multiple copies of the plasmid DNA tandemly integrated into the host chromosome.

The application of brief, high-voltage electric pulses to a variety of mammalian and plant cells leads to the formation of nanometer-sized pores in the plasma membrane. DNA is taken directly into the cell cytoplasm either through these pores or as a consequence of the redistribution of membrane components that accompanies closure of the pores. Electroporation can be extremely efficient and can be used both for transient expression of cloned genes and for establishment of cell lines that carry integrated copies of the gene of interest. Electroporation, in contrast to calcium phosphate-mediated transfection and protoplast fusion, frequently gives rise to cell lines that carry one, or at most a few, integrated copies of the foreign DNA.

Liposome transfection involves encapsulation of DNA and RNA within liposomes, followed by fusion of the liposomes with the cell membrane. The mechanism of how DNA is delivered into the cell is unclear but transfection efficiencies can be as high as 90%.

Direct microinjection of a DNA molecule into nuclei has the advantage of not exposing DNA to cellular compartments such as low-pH endosomes. Microinjection is therefore used primarily as a method to establish lines of cells that carry integrated copies of the DNA of interest.

The use of adenovirus as a vector for cell transfection is well known in the art. Adenovirus vector-mediated cell transfection has been reported for various cells (Stratford-Perricaudet, et al. 1992).

A transfected cell can be prokaryotic or eukaryotic. Preferably, the host cells of the invention are prokaryotic host cells. Where it is of interest to produce a *Streptococcus pneumoniae* polypeptide, cultured prokaryotic host cells are of particular interest.

In yet another embodiment, the present invention contemplates a process or method of preparing *Streptococcus pneumoniae* polypeptides comprising transforming, transfecting or infecting cells with a polynucleotide that encodes a *Streptococcus pneumoniae* polypeptide to produce transformed host cells; and maintaining the transformed host cells under biological conditions sufficient for expression of the polypeptide. Preferably, the transformed host cells are prokaryotic cells. Alternatively, the host cells are eukaryotic cells. More preferably, the prokaryotic cells are bacterial cells of the DH5-α strain of *Escherichia coli*. Even more preferably, the polynucleotide transfected into the transformed cells comprise the nucleic acid sequence of one of SEQ ID NO: 1 through SEQ ID NO: 215 or SEQ ID NO: 431 through SEQ ID NO: 591. Additionally, transfection is accomplished using an expression vector disclosed above. A host cell used in the process is capable of expressing a functional, recombinant *Streptococcus pneumoniae* polypeptide.

Following transfection, the cell is maintained under culture conditions for a period of time sufficient for expression of a *Streptococcus pneumoniae* polypeptide. Culture conditions are well known in the art and include ionic composition and concentration, temperature, pH and the like. Typically, transfected cells are maintained under culture conditions in a culture medium. Suitable media for various cell types are well known in the art. In a preferred embodiment, temperature is from about 20° C. to about 50° C., more preferably from about 30° C. to about 40° C. and, even more preferably about 37° C.

The pH is preferably from about a value of 6.0 to a value of about 8.0, more preferably from about a value of about 6.8 to a value of about 7.8 and, most preferably about 7.4. Osmolality is preferably from about 200 milliosmols per liter (mosm/L) to about 400 mosm/l and, more preferably from about 290 mosm/L to about 310 mosm/L. Other biological conditions needed for transfection and expression of an encoded protein are well known in the art.

Transfected cells are maintained for a period of time sufficient for expression of an *Streptococcus pneumoniae* polypeptide. A suitable time depends inter alia upon the cell type used and is readily determinable by a skilled artisan. Typically, maintenance time is from about 2 to about 14 days.

Recombinant *Streptococcus pneumoniae* polypeptide is recovered or collected either from the transfected cells or the medium in which those cells are cultured. Recovery comprises isolating and purifying the *Streptococcus pneumoniae* polypeptide. Isolation and purification techniques for polypeptides are well known in the art and include such procedures as precipitation, filtration, chromatography, electrophoresis and the like.

F. Antibodies Immunoreactive with *Streptococcus Pneumoniae* Polypeptides

In still another embodiment, the present invention provides antibodies immunoreactive with *Streptococcus pneumoniae* polypeptides. Preferably, the antibodies of the invention are monoclonal antibodies. Additionally, the *Streptococcus pneumoniae* polypeptides comprise the amino acid residue sequence of one of SEQ ID NO:216 through SEQ ID NO:430 or SEQ ID NO: 592 through SEQ ID NO: 752. Means for preparing and characterizing antibodies are well known in the art (See, e.g., Antibodies "A Laboratory Manual", E. Harlow and D. Lane, Cold Spring Harbor Laboratory, 1988).

Briefly, a polyclonal antibody is prepared by immunizing an animal with an immunogen comprising a polypeptide or polynucleotide of the present invention, and collecting antisera from that immunized animal. A wide range of animal species can be used for the production of antisera. Typically an animal used for production of anti-antisera is a rabbit, a mouse, a rat, a hamster or a guinea pig. Because of the relatively large blood volume of rabbits, a rabbit is a preferred choice for production of polyclonal antibodies.

As is well known in the art, a given polypeptide or polynucleotide may vary in its immunogenicity. It is often necessary therefore to couple the immunogen (e.g., a polypeptide or polynucleotide) of the present invention with a carrier. Exemplary and preferred carriers are $CRM_{197}$, keyhole limpet hemocyanin (KLH) and bovine serum albumin (BSA). Other albumins such as ovalbumin, mouse serum albumin or rabbit serum albumin can also be used as carriers.

Means for conjugating a polypeptide or a polynucleotide to a carrier protein are well known in the art and include glutaraldehyde, m-maleimidobencoyl-N-hydroxysuccinimide ester, carbodiimide and bis-biazotized benzidine.

The amount of immunogen used for the production of polyclonal antibodies varies inter alia, upon the nature of the immunogen as well as the animal used for immunization. A variety of routes can be used to administer the immunogen (subcutaneous, intramuscular, intradermal, intravenous and intraperitoneal). The production of polyclonal antibodies is monitored by sampling blood of the immunized animal at various points following immunization. When a desired level of immunogenicity is obtained, the immunized animal can be bled and the serum isolated and stored.

In another aspect, the present invention contemplates a process of producing an antibody immunoreactive with a *Streptococcus pneumoniae* polypeptide comprising the steps of (a) transfecting recombinant host cells with a polynucleotide that encodes a *Streptococcus pneumoniae* polypeptide; (b) culturing the host cells under conditions sufficient for expression of the polypeptide; (c) recovering the polypeptides; and (d) preparing the antibodies to the polypeptides. Preferably, the host cell is transfected with the polynucleotide of one of SEQ ID NO:1 through SEQ ID NO:215 or SEQ ID NO: 431 through SEQ ID NO: 591. Even more preferably, the present invention provides antibodies prepared according to the process described above.

A monoclonal antibody of the present invention can be readily prepared through use of well-known techniques such as those exemplified in U.S. Pat. No. 4,196,265, hereinafter incorporated by reference. Typically, a technique involves first immunizing a suitable animal with a selected antigen (e.g., a polypeptide or polynucleotide of the present invention) in a manner sufficient to provide an immune response. Rodents, such as mice and rats, are preferred animals. Spleen cells from the immunized animal are then fused with cells of an immortal myeloma cell. Where the immunized animal is a mouse, a preferred myeloma cell is a murine NS-1 myeloma cell.

The fused spleen/myeloma cells are cultured in a selective medium to select fused spleen/myeloma cells from the parental cells. Fused cells are separated from the mixture of non-fused parental cells, e.g., by the addition of agents that block the de novo synthesis of nucleotides in the tissue culture media. Exemplary and preferred agents are aminopterin, methotrexate, and azaserine. Aminopterin and methotrexate block de novo synthesis of both purines and pyrimidines, whereas azaserine blocks only purine synthesis. Where aminopterin or methotrexate is used, the media is supplemented with hypoxanthine and thymidine as a source of nucleotides. Where azaserine is used, the media is supplemented with hypoxanthine.

This culturing provides a population of hybridomas from which specific hybridomas are selected. Typically, selection of hybridomas is performed by culturing the cells by single-clone dilution in microtiter plates, followed by testing the individual clonal supernatants for reactivity with an antigen-polypeptide. The selected clones can then be propagated indefinitely to provide the monoclonal antibody.

By way of specific example, to produce an antibody of the present invention, mice are injected intraperitoneally with between about 1-200 μg of an antigen comprising a polypeptide of the present invention. B lymphocyte cells are stimulated to grow by injecting the antigen in association with an adjuvant such as complete Freund's adjuvant (a non-specific stimulator of the immune response containing killed Mycobacterium tuberculosis). At some time (e.g., at least two weeks) after the first injection, mice are boosted by injection with a second dose of the antigen mixed with incomplete Freund's adjuvant.

A few weeks after the second injection, mice are tail bled and the sera titered by immunoprecipitation against radio-labeled antigen. Preferably, the process of boosting and titering is repeated until a suitable titer is achieved. The spleen of the mouse with the highest titer is removed and the spleen lymphocytes are obtained by homogenizing the spleen with a syringe. Typically, a spleen from an immunized mouse contains approximately $5 \times 10^7$ to $2 \times 10^8$ lymphocytes.

Mutant lymphocyte cells known as myeloma cells are obtained from laboratory animals in which such cells have been induced to grow by a variety of well-known methods. Myeloma cells lack the salvage pathway of nucleotide biosynthesis. Because myeloma cells are tumor cells, they can be propagated indefinitely in tissue culture, and are thus denominated immortal. Numerous cultured cell lines of myeloma cells from mice and rats, such as murine NS-1 myeloma cells, have been established.

Myeloma cells are combined under conditions appropriate to foster fusion with the normal antibody-producing cells from the spleen of the mouse or rat injected with the antigen/polypeptide of the present invention. Fusion conditions include, for example, the presence of polyethylene glycol. The resulting fused cells are hybridoma cells. Like myeloma cells, hybridoma cells grow indefinitely in culture.

Hybridoma cells are separated from unfused myeloma cells by culturing in a selection medium such as HAT media (hypoxanthine, aminopterin, thymidine). Unfused myeloma cells lack the enzymes necessary to synthesize nucleotides from the salvage pathway because they are killed in the presence of aminopterin, methotrexate, or azaserine. Unfused lymphocytes also do not continue to grow in tissue culture. Thus, only cells that have successfully fused (hybridoma cells) can grow in the selection media.

Each of the surviving hybridoma cells produces a single antibody. These cells are then screened for the production of the specific antibody immunoreactive with an antigen/polypeptide of the present invention. Single cell hybridomas are isolated by limiting dilutions of the hybridomas. The hybridomas are serially diluted many times and, after the dilutions are allowed to grow, the supernatant is tested for the presence of the monoclonal antibody. The clones producing that antibody are then cultured in large amounts to produce an antibody of the present invention in convenient quantity.

By use of a monoclonal antibody of the present invention, specific polypeptides and polynucleotide of the invention are identified as antigens. Once identified, those polypeptides and polynucleotides are isolated and purified by techniques such as antibody-affinity chromatography. In antibody-affinity chromatography, a monoclonal antibody is bound to a solid substrate and exposed to a solution containing the desired antigen. The antigen is removed from the solution through an immunospecific reaction with the bound antibody. The polypeptide or polynucleotide is then easily removed from the substrate and purified.

Additionally, examples of methods and reagents particularly amenable for use in generating and screening antibody display library can be found in, for example, U.S. Pat. No. 5,223,409; International Application WO 92/18619; International Application WO 91/17271; International Application WO 92/20791; International Application WO 92/15679; International Application WO 93/01288; International Application WO 92/01047; International Application WO 92/09690; International Application WO 90/02809.

Additionally, recombinant anti-*Streptococcus pneumoniae* antibodies, such as chimeric and humanized monoclonal antibodies, comprising both human and non-human fragments, which can be made using standard recombinant DNA techniques, are within the scope of the invention. Such chimeric and humanized monoclonal antibodies can be produced by recombinant DNA techniques known in the art, for example using methods described in International Application PCT/US86/02269; International Application EP 184, 187; International Application EP 171,496; International Application EP 173,494; International Application WO 86/01533; U.S. Pat. No. 4,816,567; and International Application EP 125,023.

An anti-*Streptococcus pneumoniae* antibody (e.g., monoclonal antibody) is used to isolate *Streptococcus pneumoniae* polypeptides by standard techniques, such as affinity chromatography or immunoprecipitation. An anti-*Streptococcus pneumoniae* antibody facilitates the purification of a natural *Streptococcus pneumoniae* polypeptide from cells and recombinantly produced *Streptococcus pneumoniae* polypeptides expressed in host cells. Moreover, an anti-*Streptococcus pneumoniae* antibody is used to detect *Streptococcus pneumoniae* polypeptide (e.g., in a cellular lysate or cell supernatant) in order to evaluate the abundance of the *Streptococcus pneumoniae* polypeptide. The detection of circulating fragments of a *Streptococcus pneumoniae* polypeptide is used to identify *Streptococcus pneumoniae* polypeptide turnover in a subject Anti-*Streptococcus pneumoniae* antibodies are used diagnostically to monitor protein levels in tissue as part of a clinical testing procedure, e.g., to, for example, determine the efficacy of a given treatment regimen. Detection is facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, P-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylarnine fluorescein, dansyl chloride or phycoerythrin; an example of a luminescent material includes luminol; examples of bioluminescent materials include luciferase, luciferin, and acquorin, and examples of suitable radioactive material include $^{125}$I, $^{131}$I, $^{15}$S or $^{3}$H.

G. Pharmaceutical and Immunogenic Compositions

In certain embodiments, the present invention provides pharmaceutical and immunogenic compositions comprising *Streptococcus pneumoniae* polypeptides and physiologically acceptable carriers. More preferably, the pharmaceutical compositions comprise one or more *Streptococcus pneumoniae* polypeptides comprising the amino acid residue sequence of one or more of SEQ ID NO:216 through SEQ ID NO:430 or SEQ ID NO: 592 through SEQ ID NO: 752. In other embodiments, the pharmaceutical compositions of the invention comprise polynucleotides that encode *Streptococcus pneumoniae* polypeptides, and physiologically acceptable carriers. Preferably, the pharmaceutical and immunogenic compositions of the present invention comprise *Streptococcus pneumoniae* polypeptides comprising the amino acid sequence of one of SEQ ID NO:216 through SEQ ID NO:430 or SEQ ID NO: 592 through SEQ ID NO: 752. Alternatively, the pharmaceutical and immunogenic compositions comprise polynucleotides comprising the nucleotide sequence of one of SEQ ID NO:1 through SEQ ID NO:215 or SEQ ID NO: 431 through SEQ ID NO: 591.

Various tests are used to assess the in vitro immunogenicity of the polypeptides of the invention. For example, an in vitro opsonic assay is conducted by incubating together a mixture of *Streptococcus pneumoniae* cells, heat inactivated human serum containing specific antibodies to the polypeptide in question, and an exogenous complement source. Opsonophagocytosis proceeds during incubation of freshly isolated human polymorphonuclear cells (PMN's) and the antibody/complement/pneumococcal cell mixture. Bacterial cells that are coated with antibody and complement are killed upon opsonophagocytosis. Colony forming units (cfu) of surviving bacteria that escape from opsonophagocytosis are determined by plating the assay mixture. Titers are reported as the reciprocal of the highest dilution that gives ≧50% bacterial killing, as determined by comparison to assay controls. Specimens which demonstrate less than 50% killing at the lowest serum dilution tested (1:8), are reported as having an OPA titer of 4. The highest dilution tested is 1:2560. Samples with ≧50% killing at the highest dilution are repeated, beginning with a higher initial dilution. The method described above is a modification of Gray's method (Gray, 1990).

A test serum control, which contains test serum plus bacterial cells and heat inactivated complement, is included for each individual serum. This control can be used to assess whether the presence of antibiotics or other serum components are capable of killing the bacterial strain directly (i.e. in the absence of complement or PMN's). A human serum with known opsonic titer is used as a positive human serum control. The opsonic antibody titer for each unknown serum can be calculated as the reciprocal of the initial dilution of serum giving 50% cfu reduction compared to the control without serum.

A whole cell ELISA assay is also used to assess in vitro immunogenicity and surface exposure of the polypeptide antigen, wherein the bacterial strain of interest (*S. pneumoniae*) is coated onto a plate, such as a 96 well plate, and test sera from an immunized animal is reacted with the bacterial cells. If any antibody, specific for the test polypeptide antigen, is reactive with a surface exposed epitope of the polypeptide antigen, it can be detected by standard methods known to one skilled in the art.

Any polypeptide demonstrating the desired in vitro activity is then tested in an in vivo animal challenge model. In certain embodiments, immunogenic compositions are used in the immunization of an animal (e.g., a mouse) by methods and routes of immunization known to those of skill in the art (e.g., intranasal, parenteral, oral, rectal, vaginal, transdermal, intraperitoneal, intravenous, subcutaneous, etc.). Following immunization of the animal with a particular *Streptococcus pneumoniae* immunogenic composition, the animal is challenged with *Streptococcus pneumoniae* and assayed for resistance to *Streptococcus pneumoniae* infection.

In one embodiment, six-week old, pathogen-free, Balb/c mice are immunized and challenged with *Streptococcus pneumoniae*. For example, BALB/C mice, at 10 animals per group, are immunized (by slow instillation into the nostrils of each mouse) with one or more doses of the desired polypeptide in an immunogenic composition. *Streptococcus pneumoniae* colonizes the nasopharynx of Balb/c mice, but does not cause disease or death. Subsequently, the Balb/c mice are challenged with streptomycin-resistant *Streptococcus pneumoniae*. The Balb/c mice are sacrificed post-challenge, the noses removed, and homogenized in sterile saline. The homogenate is diluted in saline and plated on streptomycin-containing TSA plates. Plates are incubated overnight at 37° C. and then colonies are counted. Statistically significant reduction of nasopharyngeal colonization indicates that the polypeptide is suitable for use in human clinical trials.

In another embodiment, six-week old, pathogen-free, male CBA/CaHN xid/J (CBA/N) mice are immunized intranasally or parenterally prior to *Streptococcus pneumoniae* challenge. CBA/N mice, at 10 animals per group, are immunized with an appropriate amount of the desired polypeptide in an immunogenic composition to be tested. CBA/N mice are immunodeficient (XID) and, when challenged with appropriate *Streptococcus pneumoniae*, develop nasopharyngeal colonization, bacteremia and death.

The CBA/N mice are immunized intranasally or subcutaneously with one or more doses of the desired immunogenic composition. Subsequently, the CBA/N mice are challenged with streptomycin-resistant *Streptococcus pneumoniae*. To determine the effects of immunization on intranasal colonization, the CBA/N mice are sacrificed post-challenge, the noses are removed, and homogenized in sterile saline. The homogenate is serially diluted in saline and plated on streptomycin-containing TSA plates. In addition, blood collected post-challenge from each mouse is also plated on streptomycin-containing TSA plates to determine levels of bacteremia. Plates are incubated overnight at 37° C. and then colonies are counted. In another embodiment, CBA/N mice are immunized as described above and challenged intranasally. The CBA/N mice are observed daily after challenge, and the mortality is monitored for 14 days. Statistically significant reduction of nasopharyngeal colonization and/or mortality indicates that the polypeptide is suitable for use in human clinical trials.

The *Streptococcus pneumoniae* polynucleotides, polypeptides, modulators of a *Streptococcus pneumoniae* polypeptides, and anti-*Streptococcus pneumoniae* antibodies (also referred to hereinafter as "active compounds") of the invention are incorporated into pharmaceutical and immunogenic compositions suitable for administration to a subject, e.g., a human. Such compositions typically comprise the nucleic acid molecule, protein, modulator, or antibody and a pharmaceutically acceptable carrier. As used hereinafter the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, such media can be used in the compositions of the invention. Supplementary active compounds can also be incorporated into the compositions.

A pharmaceutical or immunogenic composition of the invention is formulated to be compatible with its intended route of administration. Examples of routes of administration include parenteral (e.g., intravenous, intradermal, subcutaneous, intraperitoneal), transmucosal (e.g., oral, rectal, intranasal, vaginal, respiratory) and transdermal (topical). Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic add or sodium bisulfite; chelating agents such as ethylenediaminetetraacetic add; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor ELTM (BASF, Parsippany, N.J.) or phosphate buffered saline (PBS). In all cases, the composition must be sterile and should be fluid to the extent that easy syringability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound (e.g., a *Streptococcus pneumoniae* polypeptide or ant-*Streptococcus pneumoniae* antibody) in the required amount in an appropriate solvent with one or a combination of ingredients enumerated above, as required, followed by filtered sterilization. Generally, dispersions are prepared by incorporating the active compound into a sterile vehicle which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer. Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implants and microencapsulated delivery systems.

Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811 which is incorporated hereinafter by reference.

It is especially advantageous to formulate oral or parenteral compositions in dosage unit form for ease of administration and uniformity of dosage. Dosage unit form as used hereinafter refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the invention are dictated by and directly dependent on the unique characteristics of the active compound and the particular therapeutic effect to be achieved, and the limitations inherent in the art of compounding such an active compound for the treatment of individuals.

Combination immunogenic compositions are provided by including two or more of the polypeptides of the invention, as well as by combining one or more of the polypeptides of the invention with one or more known *S. pyogenes* polypeptides, including, but not limited to, the C5a peptidase, the M proteins, adhesins and the like.

In other embodiments, combination immunogenic compositions are provided by combining one or more of the polypeptides of the invention with one or more known *S. pneumoniae* polysaccharides or polysaccharide-protein conjugates, including, but not limited to, the currently available 23-valent pneumococcal capsular polysaccharide vaccine and the 7-valent pneumococcal polysaccharide-protein conjugate vaccine.

The nucleic acid molecules of the invention are inserted into a variety of vectors and expression systems. A great variety of expression systems are used. Such systems include, among others, chromosomal, episomal and virus-derived systems, e.g., vectors derived from bacterial plasmids, attenuated bacteria such as Salmonella (U.S. Pat. No. 4,837,151) from bacteriophage, from transposons, from yeast episomes, from insertion elements, from yeast chromosomal elements, from viruses such as vaccinia and other poxviruses, sindbis, adenovirus, baculoviruses, papova viruses, such as SV40, fowl pox viruses, pseudorabies viruses and retroviruses, alphaviruses such as Venezuelan equine encephalitis virus (U.S. Pat. No. 5,643,576), nonsegmented negative-stranded RNA viruses such as vesicular stomatitis virus (U.S. Pat. No. 6,168,943), and vectors derived from combinations thereof, such as those derived from plasmid and bacteriophage genetic elements, such as cosmids and phagemids. The expression systems should include control regions that regulate as well as engender expression, such as promoters and other regulatory elements (such as a polyadenylation signal). Generally, any system or vector suitable to maintain, propagate or express polynucleotides to produce a polypeptide in a host may be used. The appropriate nucleotide sequence may be inserted into an expression system by any of a variety of well-known and routine techniques, such as, for example, those set forth in Sambrook et al., "Molecular Cloning: A Laboratory Manual" 2nd, ed, Cold Spring Harbor Laboratory, Cold Spring Harbor Laboratory Press, Cold Spring Harbor, N.Y., 1989.

A pharmaceutically acceptable vehicle is understood to designate a compound or a combination of compounds entering into a pharmaceutical or immunogenic composition which does not cause side effects and which makes it possible, for example, to facilitate the administration of the active compound, to increase its life and/or its efficacy in the body, to increase its solubility in solution or alternatively to enhance its preservation. These pharmaceutically acceptable vehicles are well known and will be adapted by persons skilled in the art according to the nature and the mode of administration of the active compound chosen.

As defined hereinafter, an "adjuvant" is a substance that serves to enhance the immunogenicity of an "antigen" or the immunogenic compositions comprising a polypeptide antigens having an amino acid sequence chosen from one of SEQ ID NO:216 through SEQ ID NO:430 or SEQ ID NO: 592 through SEQ ID NO: 752. Thus, adjuvants are often given to boost the immune response and are well known to the skilled artisan. Examples of adjuvants contemplated in the present invention include, but are not limited to, aluminum salts (alum) such as aluminum phosphate and aluminum hydroxide, Mycobacterium tuberculosis, Bordetella pertussis, bacterial lipopolysaccharides, aminoalkyl glucosamine phosphate compounds (AGP), or derivatives or analogs thereof, which are available from Corixa (Hamilton, Mont.), and which are described in U.S. Pat. No. 6,113,918; one such AGP is 2-[(R)-3-Tetradecanoyloxytetradecanoylamino]ethyl 2-Deoxy-4-O-phosphono-3-O-[(R)-3-tetradecanoyoxytetradecanoyl]-2-[(R)-3-tetradecanoyoxytetradecanoylamino]-b-D-glucopyranoside, which is also known as 529 (formerly known as RC529), which is formulated as an aqueous form or as a stable emulsion, MPL™ (3-O-deacylated monophosphoryl lipid A) (Corixa) described in U.S. Pat. No. 4,912,094, synthetic polynucleotides such as oligonucleotides containing a CpG motif (U.S. Pat. No. 6,207, 646), polypeptides, saponins such as Quil A or STIMULON™ QS-21 (Antigenics, Framingham, Mass.), described in U.S. Pat. No. 5,057,540, a pertussis toxin (PT), or an E. coli heat-labile toxin (LT), particularly LT-K63, LT-R72, CT-S109, PT-K9/G129; see, e.g., International Patent Publication Nos. WO 93/13302 and WO 92/19265, cholera toxin (either in a wild-type or mutant form, e.g., wherein the glutamic acid at amino acid position 29 is replaced by another amino acid, preferably a histidine, in accordance with published International Patent Application number WO 00/18434). Various cytokines and lymphokines are suitable for use as adjuvants. One such adjuvant is granulocyte-macrophage colony stimulating factor (GM-CSF), which has a nucleotide sequence as described in U.S. Pat. No. 5,078,996. A plasmid containing GM-CSF cDNA has been transformed into E. coli and has been deposited with the American Type Culture Collection (ATCC), 1081 University Boulevard, Manassas, Va. 20110-2209, under Accession Number 39900. The cytokine Interleukin-12(IL-12) is another adjuvant which is described in U.S. Pat. No. 5,723, 127. Other cytokines or lymphokines have been shown to have immune modulating activity, including, but not limited to, the interleukins 1-alpha, 1-beta, 2, 4, 5,6, 7, 8, 10, 13, 14, 15, 16, 17 and 18, the interferons-alpha, beta and gamma, granulocyte colony stimulating factor, and the tumor necrosis factors alpha and beta, and are suitable for use as adjuvants.

A composition of the present invention is typically administered parenterally in dosage unit formulations containing standard, well-known nontoxic physiologically acceptable carriers, adjuvants, and vehicles as desired. The term parenteral as used hereinafter includes intravenous, intramuscular, intraarterial injection, or infusion techniques.

Injectable preparations, for example sterile injectable aqueous or oleaginous suspensions, are formulated according to the known art using suitable dispersing or wetting agents and suspending agents. The sterile injectable preparation can also be a sterile injectable solution or suspension in a nontoxic parenterally acceptable diluent or solvent, for example, as a solution in 1,3-butanediol.

Among the acceptable vehicles and solvents that may be employed are water, Ringer's solution, and isotonic sodium chloride solution. In addition, sterile, fixed oils are conventionally employed as a solvent or suspending medium. For this purpose any bland fixed oil can be employed including synthetic mono- or di-glycerides. In addition, fatty acids such as oleic acid find use in the preparation of injectables.

Preferred carriers include neutral saline solutions buffered with phosphate, lactate, Tris, and the like. Of course, when administering viral vectors, one purifies the vector sufficiently to render it essentially free of undesirable contaminants, such as defective interfering adenovirus particles or endotoxins and other pyrogens such that it does not cause any untoward reactions in the individual receiving the vector construct. A preferred means of purifying the vector involves the use of buoyant density gradients, such as cesium chloride gradient centrifugation.

A carrier can also be a liposome. Means for using liposomes as delivery vehicles are well known in the art (see, e.g. Gabizon et al., 1990; Ferruti et al., 1986; and Ranade, 1989).

The immunogenic compositions of this invention also comprise a polynucleotide sequence of this invention operatively associated with a regulatory sequence that controls gene expression. The polynucleotide sequence of interest is engineered into an expression vector, such as a plasmid, under the control of regulatory elements which will promote expression of the DNA, that is, promoter and/or enhancer elements. In a preferred embodiment, the human cytomegalovirus immediate-early promoter/enhancer is used (U.S. Pat. No. 5,168,062). The promoter may be cell-specific and permit substantial transcription of the polynucleotide only in predetermined cells.

The polynucleotide is introduced directly into the host either as "naked" DNA (U.S. Pat. No. 5,580,859) or formulated in compositions with agents which facilitate immunization, such as bupivicaine and other local anesthetics (U.S. Pat. No. 5,593,972) and cationic polyamines (U.S. Pat. No. 6,127,170).

In this polynucleotide immunization procedure, the polypeptides of the invention are expressed on a transient basis in vivo; no genetic material is inserted or integrated into the chromosomes of the host. This procedure is to be distinguished from gene therapy, where the goal is to insert or integrate the genetic material of interest into the chromosome. An assay is used to confirm that the polynucleotides administered by immunization do not give rise to a transformed phenotype in the host (U.S. Pat. No. 6,168,918).

H. Uses and Methods of the Invention

The Streptococcus pneumoniae polynucleotides, polypeptides, polypeptide homologues, modulators, adjuvants, and antibodies described in this invention can be used in methods of treatment, diagnostic assays particularly in disease identification, drug screening assays and monitoring of effects during clinical trials. The isolated polynucleotides of the invention can be used to express Streptococcus pneumoniae polypeptides (e.g., via a recombinant expression vector in a host cell or in polynucleotide immunization applications) and to detect Streptococcus pneumoniae mRNA (e.g., in a biological sample). Moreover, the anti-Streptococcus pneumoniae antibodies of the invention can be used to detect and isolate a Streptococcus pneumoniae polypeptide, particularly fragments of a Streptococcus pneumoniae polypeptides present in a biological sample, and to modulate Streptococcus pneumoniae polypeptide activity.

The invention provides immunogenic compositions comprising polypeptides having an amino acid sequence chosen from one of SEQ ID NO:216 through SEQ ID NO:430 or SEQ ID NO: 592 through SEQ ID NO: 752, a biological equivalent thereof or a fragment thereof. The immunogenic composition may further comprise a pharmaceutically acceptable carrier, as outlined in section G. In certain preferred embodiments, the immunogenic composition will comprise one or more adjuvants.

In another embodiment, the invention provides immunogenic compositions comprising a polynucleotide having a nucleotide sequence chosen from one of SEQ ID NO:1 through SEQ ID NO:215 or SEQ ID NO: 431 through SEQ ID NO: 591, wherein the polynucleotide is comprised in a recombinant expression vector. Preferably the vector is plasmid DNA. Of course, the polynucleotide may further comprise heterologous nucleotides, e.g., the polynucleotide is operatively linked to one or more gene expression regulatory elements, and further comprise one or more adjuvants. In a preferred embodiment, the immunogenic polynucleotide composition directs the expression of a neutralizing epitope of *Streptococcus pneumoniae*.

Provided also are methods for immunizing a host against *Streptococcus pneumoniae* infection. In a preferred embodiment, the host is human. Thus, a host or subject is administered an immunizing amount of an immunogenic composition comprising a polypeptide having an amino acid sequence chosen from one of SEQ ID NO:216 through SEQ ID NO:430 or SEQ ID NO: 592 through 752, a biological equivalent thereof or a fragment thereof and a pharmaceutically acceptable carrier. An immunizing amount of an immunogenic composition can be determined by doing a dose response study in which subjects are immunized with gradually increasing amounts of the immunogenic composition and the immune response analyzed to determine the optimal dosage. Starting points for the study can be inferred from immunization data in animal models. The dosage amount can vary depending upon specific conditions of the individual. The amount can be determined in routine trials by means known to those skilled in the art.

An immunologically effective amount of the immunogenic composition in an appropriate number of doses is administered to the subject to elicit an immune response. Immunologically effective amount, as used herein, means the administration of that amount to a mammalian host (preferably human), either in a single dose or as part of a series of doses, sufficient to at least cause the immune system of the individual treated to generate a response that reduces the clinical impact of the bacterial infection. Protection may be conferred by a single dose of the immunogenic composition or vaccine, or may require the administration of several doses, in addition to booster doses at later times to maintain protection. This may range from a minimal decrease in bacterial burden to prevention of the infection. Ideally, the treated individual will not exhibit the more serious clinical manifestations of the *Streptococcus pneumoniae* infection. The dosage amount can vary depending upon specific conditions of the individual, such as age and weight. This amount can be determined in routine trials by means known to those skilled in the art.

I. Diagnostic Assays

The invention provides methods for detecting the presence of a *Streptococcus pneumoniae* polypeptide or *Streptococcus pneumoniae* polynucleotide, or fragment thereof, in a biological sample. The method involves contacting the biological sample with a compound or an agent capable of detecting a *Streptococcus pneumoniae* polypeptide or mRNA such that the presence of the *Streptococcus pneumoniae* polypeptide/encoding nucleic acid molecule is detected in the biological sample. A preferred agent for detecting *Streptococcus pneumoniae* mRNA or DNA is a labeled or labelable oligonucleotide probe capable of hybridizing to *Streptococcus pneumoniae* mRNA or DNA. The nucleic acid probe can be, for example, a full-length *Streptococcus pneumoniae* polynucleotide of one of SEQ ID NO: 1 through SEQ ID NO:215 or SEQ ID NO: 431 through SEQ ID NO: 591, a complement thereof, or a fragment thereof, such as an oligonucleotide of at least 15, 30, 50, 100, 250 or 500 nucleotides in length and sufficient to specifically hybridize under stringent conditions to *Streptococcus pneumoniae* mRNA or DNA. Alternatively, the sample can be contacted with an oligonucleotide primer of a *Streptococcus pneumoniae* polynucleotide of one of SEQ ID NO: 1 through SEQ ID NO:215 or SEQ ID NO: 431 through SEQ ID NO: 591, a complement thereof, or a fragment thereof, in the presence of nucleotides and a polymerase, under conditions permitting primer extension.

A preferred agent for detecting *Streptococcus pneumoniae* polypeptide is a labeled or labelable antibody capable of binding to a *Streptococcus pneumoniae* polypeptide. Antibodies can be polyclonal, or more preferably, monoclonal. An intact antibody, or a fragment thereof (e.g., Fab or F(ab')2) can be used. The term "labeled or labelable," with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin. The term "biological sample" is intended to include tissues, cells and biological fluids isolated from a subject, as well as tissues, cells and fluids present within a subject. That is, the detection method of the invention can be used to detect *Streptococcus pneumoniae* mRNA, DNA, or protein in a biological sample in vitro as well as in vivo. For example, in vitro techniques for detection of *Streptococcus pneumoniae* mRNA include Northern hybridizations and in situ hybridizations. In vitro techniques for detection of *Streptococcus pneumoniae* polypeptide include enzyme linked immunosorbent assays (ELISAs), Western blots, immunoprecipitations and immunofluorescence. Alternatively, *Streptococcus pneumoniae* polypeptides can be detected in vivo in a subject by introducing into the subject a labeled anti-*Streptococcus pneumoniae* antibody. For example, the antibody can be labeled with a radioactive marker whose presence and location in a subject can be detected by standard imaging techniques.

The polynucleotides according to the invention may also be used in analytical DNA chips, which allow sequencing, the study of mutations and of the expression of genes, and which are currently of interest given their very small size and their high capacity in terms of number of analyses.

The principle of the operation of these chips is based on molecular probes, most often oligonucleotides, which are attached onto a miniaturized surface, generally of the order of a few square centimeters. During an analysis, a sample containing fragments of a target nucleic acid to be analysed, for example DNA or RNA labelled, for example, after amplification, is deposited onto the DNA chip in which the support has been coated beforehand with probes. Bringing the labelled target sequences into contact with the probes leads to the formation, through hybridization, of a duplex according to the rule of pairing defined by J. D. Watson and F. Crick. After a washing step, analysis of the surface of the chip allows the effective hybridizations to be located by means of the signals emitted by the labels tagging the target. A hybridization fingerprint results from this analysis which, by appropriate computer processing, will make it possible to determine information such as the presence of specific fragments in the sample, the determination of sequences and the presence of mutations.

The chip consists of a multitude of molecular probes, precisely organized or arrayed on a solid support whose surface is miniaturized. It is at the centre of a system where other elements (imaging system, microcomputer) allow the acquisition and interpretation of a hybridization fingerprint.

The hybridization supports are provided in the form of flat or porous surfaces (pierced with wells) composed of various materials. The choice of a support is determined by its physicochemical properties, or more precisely, by the relationship between the latter and the conditions under which the support will be placed during the synthesis or the attachment of the probes or during the use of the chip. It is therefore necessary, before considering the use of a particular support, to consider characteristics such as its stability to pH, its physical strength, its reactivity and its chemical stability as well as its capacity to nonspecifically bind nucleic acids. Materials such as glass, silicon and polymers are commonly used. Their surface is, in a first step, called "functionalization", made reactive towards the groups which it is desired to attach thereon. After the functionalization, so-called spacer molecules are grafted onto the activated surface. Used as intermediates between the surface and the probe, these molecules of variable size render unimportant the surface properties of the supports, which often prove to be problematic for the synthesis or the attachment of the probes and for the hybridization.

Among the hybridization supports, there may be mentioned glass which is used, for example, in the method of in situ synthesis of oligonucleotides by photochemical addressing developed by the company Affymetrix (E. L. Sheldon, 1993), the glass surface being activated by silane. Genosensor Consortium (P. Mérel, 1994) also uses glass slides carrying wells 3 mm apart, this support being activated with epoxysilane.

The probes according to the invention may be synthesized directly in situ on the supports of the DNA chips. This in situ synthesis may be carried out by photochemical addressing (developed by the company Affymax (Amsterdam, Holland) and exploited industrially by its subsidiary Affymetrix (United States), or based on the VLSIPS (very large scale immobilized polymer synthesis) technology (S. P. A. Fodor et al., 1991), which is based on a method of photochemically directed combinatory synthesis. The principle of which combines solid-phase chemistry, the use of photolabile protecting groups and photolithography.

The probes according to the invention may be attached to the DNA chips in various ways such as electrochemical addressing, automated addressing or the use of probe printers (T. Livache et al., 1994; G. Yershov et al., 1996; J. Derisi et al., 1996, and S. Borman, 1996).

The revealing of the hybridization between the probes of the invention, deposited or synthesized in situ on the supports of the DNA chips, and the sample to be analysed, may be determined, for example, by measurement of fluorescent signals, by radioactive counting or by electronic detection.

The use of fluorescent molecules such as fluorescein constitutes the most common method of labelling the samples. It allows direct or indirect revealing of the hybridization and allows the use of various fluorochromes.

Affymetrix currently provides an apparatus or a scanner designed to read its Gene Chip™ chips. It makes it possible to detect the hybridizations by scanning the surface of the chip in confocal microscopy (R. J. Lipshutz et al., 1995).

The nucleotide sequences according to the invention may also be used in DNA chips to carry out the analysis of the expression of the *Streptococcus pneumoniae* genes. This analysis of the expression of *Streptococcus pneumoniae* genes is based on the use of chips where probes of the invention, chosen for their specificity to characterize a given gene, are present (D. J. Lockhart et al., 1996; D. D. Shoemaker et al., 1996). For the methods of analysis of gene expression using the DNA chips, reference may, for example, be made to the methods described by D. J. Lockhart et al., (1996) and Sosnowsky et al., (1997) for the synthesis of probes in situ or for the addressing and the attachment of previously synthesized probes. The target sequences to be analysed are labelled and in general fragmented into sequences of about 50 to 100 nucleotides before being hybridized onto the chip. After washing as described, for example, by D. J. Lockhart et al (1996) and application of different electric fields (Sosnowsky et al., 1997), the labelled compounds are detected and quantified, the hybridizations being carried out at least in duplicate. Comparative analyses of the signal intensities obtained with respect to the same probe for different samples and/or for different probes with the same sample, determine the differential expression of RNA or copy numbers of DNA derived from the sample.

The nucleotide sequences according to the invention may, in addition, be used in DNA chips where other nucleotide probes specific for other microorganisms are also present, and may allow the carrying out of a serial test allowing rapid identification of the presence of a microorganism in a sample.

Accordingly, the subject of the invention is also the nucleotide sequences according to the invention, characterized in that they are immobilized on a support of a DNA chip.

The DNA chips, characterized in that they contain at least one nucleotide sequence according to the invention, immobilized on the support of the said chip, also form part of the invention.

The chips will preferably contain several probes or nucleotide sequences of the invention of different length and/or corresponding to different genes so as to identify, with greater certainty, the specificity of the target sequences or the desired mutation in the sample to be analysed.

Accordingly, the analyses carried out by means of primers and/or probes according to the invention, immobilized on supports such as DNA chips, will make it possible, for example, to identify, in samples, mutations linked to variations such as intraspecies variations. These variations may be correlated or associated with pathologies specific to the variant identified and will make it possible to select the appropriate treatment.

The invention thus comprises a DNA chip according to the invention, characterized in that it contains, in addition, at least one nucleotide sequence of a microorganism different from *Streptococcus pneumoniae*, immobilized on the support of the said chip; preferably, the different microorganism will be chosen from an associated microorganism, a bacterium of the Streptococcus family, and a variant of the species *Streptococcus pneumoniae*.

The principle of the DNA chip as explained above, may also be used to produce protein "chips" on which the support has been coated with a polypeptide or an antibody according to the invention, or arrays thereof, in place of the DNA. These protein "chips" make it possible, for example, to analyse the biomolecular interactions (BIA) induced by the affinity capture of target analytes onto a support coated, for example, with proteins, by surface plasma resonance (SPR). Reference may be made, for example, to the techniques for coupling proteins onto a solid support which are described in International Application EP 524 800 or to the methods describing the use of biosensor-type protein chips such as the BIAcore-type technique (Pharmacia) (Arlinghaus et al., 1997, Krone et al., 1997, Chatelier et al., 1995). These polypeptides or antibodies according to the invention, capable of specifically binding antibodies or polypeptides derived from the sample to be analysed, may thus be used in protein chips for the detection and/or the identification of proteins in samples. The said protein chips may in particular be used for infectious diagnosis and may preferably contain, per chip, several polypeptides and/or antibodies of the invention of different specificity, and/or polypeptides and/or antibodies capable of recognizing microorganisms different from *Streptococcus pneumoniae*.

Accordingly, the subject of the present invention is also the polypeptides and the antibodies according to the invention, characterized in that they are immobilized on a support, in particular of a protein chip.

The protein chips, characterized in that they contain at least one polypeptide or one antibody according to the invention immobilized on the support of the said chip, also form part of the invention.

The invention comprises, in addition, a protein chip according to the invention, characterized in that it contains, in addition, at least one polypeptide of a microorganism different from *Streptococcus pneumoniae* or at least one antibody directed against a compound of a microorganism different from *Streptococcus pneumoniae*, immobilized on the support of the chip.

The invention also relates to a kit or set for the detection and/or the identification of bacteria belonging to the species *Streptococcus pneumoniae* or to an associated microorganism, or for the detection and/or the identification of a microorganism characterized in that it comprises a protein chip according to the invention.

The present invention also provides a method for the detection and/or the identification of bacteria belonging to the species *Streptococcus pneumoniae* or to an associated microorganism in a biological sample, characterized in that it uses a nucleotide sequence according to the invention.

The invention also encompasses kits for detecting the presence of a *Streptococcus pneumoniae* polypeptide in a biological sample. For example, the kit comprises reagents such as a labeled or labelable compound or agent capable of detecting *Streptococcus pneumoniae* polypeptide or mRNA in a biological sample; means for determining the amount of *Streptococcus pneumoniae* polypeptide in the sample; and means for comparing the amount of *Streptococcus pneumoniae* polypeptide in the sample with a standard. The compound or agent is packaged in a suitable container. The kit further comprises instructions for using the kit to detect *Streptococcus pneumoniae* mRNA or protein.

In certain embodiments, detection involves the use of a probe/primer in a polymerase chain reaction (PCR) (see, e.g. U.S. Pat. No. 4,683,195 and U.S. Pat. No. 4,683,202), such as anchor PCR or RACE PCR, or, alternatively, in a ligation chain reaction (LCR). This method includes the steps of collecting a sample of cells from a patient, isolating nucleic acid (e.g., genomic, mRNA or both) from the cells of the sample, contacting the nucleic acid sample with one or more primers which specifically hybridize to a *Streptococcus pneumoniae* polynucleotide under conditions such that hybridization and amplification of the *Streptococcus pneumoniae*-polynucleotide (if present) occurs, and detecting the presence or absence of an amplification product, or detecting the size of the amplification product and comparing the length to a control sample.

All patents and publications cited herein are hereby incorporated by reference.

EXAMPLES

The following examples are carried out using standard techniques, which are well known and routine to those of skill in the art, except where otherwise described in detail. The following examples are presented for illustrative purpose, and should not be construed in any way limiting the scope of this invention.

Example 1

Bioinformatics and Gene Mining of *Streptococcus Pneumoniae*

The genomic sequence of *Streptococcus pneumoniae* was downloaded from The Institute for Genomic Research (TIGR) website and novel open reading frames (ORFs) were determined in the following manner. An ORF was defined as having one of three potential start site codons, ATG, GTG or TTG and one of three potential stop codons, TAA, TAG or TGA. The inventors used a unique set of two ORF finder algorithms: GLIMMER (Salzberg et al., 1998) and inventors' assignee's program ton enhance the efficiency for finding "all" ORFs. In order to evaluate the accuracy of the ORFs determined, a program developed by inventors' assignee called DiCTion was employed that uses a discrete mathematical cosine function to assign a score for each ORF. An ORF with a DiCTion score >1.5 is considered to have a high probability of encoding a protein product. The minimum length of an ORF predicted by the two ORF finding algorithms was set to 225 nucleotides (including stop codon) which would encode a protein of 74 amino acids. As a final search for remnants of ORFs, all noncoding regions >75 nucleotides were searched against the public protein databases (described below) using tBLASTn. This helped to identify regions of genes that contain frameshifts (Mejlhede et al., 1999) or fragments of genes that might have a role in causing antigenic variation (Fraser et al., 1997). A graphical analysis program developed by inventors' assignee also allowed the inventors to see all six reading frames and the location of the predicted ORFs relative to the genomic sequence for further inspection. This helped to eliminate those ORFs that have large overlaps with other ORFs, although there are known cases of ORFs being totally embedded within other ORFs (Loessner et al., 1999; Hernandez-Sanchez et al., 1998).

The initial annotation of the *Streptococcus pneumoniae* ORFs was performed using the BLAST (v. 2.0) Gapped search algorithm, Blastp, to identify homologous sequences (Altschul et al., 1997). A cutoff 'e' value of anything $<e^{-10}$ was considered significant. Other search algorithms such as FASTA or PSI-BLAST were used as needed. The non-redundant protein sequence database used for the homology searches consisted of GenBank, SWISS-PROT (Bairoch and Apweiler, 2000), PIR (Barker et al., 2001), and TREMBL (Bairoch and Apweiler, 2000) database sequences updated daily. ORFs with a Blastp result of $>e^{-10}$ were considered to be unique to *Streptococcus pneumoniae*.

A keyword search of the entire BLAST results was carried out using known or suspected target genes for immunogenic compositions, as well as words that identified the location of a protein or function.

Several parameters were used to determine grouping of the predicted proteins. Proteins destined for translocation across the cytoplasmic membrane encode a leader signal (also called signal sequence) composed of a central hydrophobic region flanked at the N-terminus by positively charged residues (Pugsley, 1993). A program, called SignalP, identifies signal peptides and their cleavage sites (Nielsen et al., 1997). To predict protein localization in bacteria, the software PSORT has been used (Nakai and Kanehisa, 1991). This program uses a neural net algorithm to predict localization of proteins to the 'cytoplasm', 'periplasm', and 'cytoplasmic membrane' for Gram-positive bacteria as well as 'outer membrane' for Gram-negative bacteria. Transmembrane (TM) domains of proteins have been analyzed using the software program TopPred II (Cserzo et al., 1997).

The Hidden Markov Model (HMM) Pfam database of multiple alignments of protein domains or conserved protein regions (Sonnhammer et al., 1997) was used to identify *Streptococcus pneumoniae* proteins that may belong to an existing protein family. Keyword searching of this output was used to help identify additional candidate ORFs that may have been missed by the BLAST search criteria. A computer algorithm, called HMM Lipo, was developed by inventors' assignee to predict lipoproteins using approximately 131 biologically proven bacterial lipoproteins. This training set was generated from experimentally proven prokaryotic lipoproteins. The protein sequence from the start of the protein to the cysteine amino acid plus the next two additional amino acids was used to generate the HMM. Using approximately 70 known prokaryotic proteins containing the LPXTG cell wall sorting signal, a HMM (Eddy, 1996) was developed to predict cell wall proteins that are anchored to the peptidoglycan layer (Mazmanian et al., 1999; Navarre and Schneewind, 1999). The model used not only the LPXTG sequence but also included two features of the downstream sequence, first the hydrophobic transmembrane domain and secondly, the positively charged carboxy terminus. There are also a number of proteins that interact, non-covalently, with the peptidoglycan layer and are distinct from the LPXTG protein class described above. These proteins seem to have a consensus sequence at their carboxy terminus (Koebnik, 1995). The inventors' assignee has also developed and used a HMM of this region to identify any *Streptococcus pneumoniae* that may fall into this class of proteins.

The proteins encoded by *Streptococcus pneumoniae* identified ORFs were also evaluated for other useful characteristics. A tandem repeat finder (Benson, 1999) identified ORFs containing repeated DNA sequences such as those found in MSCRAMMs (Foster and Hook, 1998) and phase variable surface proteins of *Neisseria meningitidis* (Parkhill et al, 2000). Proteins that contain the Arg-Gly-Asp (RGD) attachment motif, together with integrins that serve as their receptor, constitute a major recognition system for cell adhesion. RGD recognition is one mechanism used by microbes to gain entry into eukaryotic tissues (Stockbauer et al., 1999; Isberg and Tran Van Nhieu, 1994). However, not all RGD containing proteins mediate cell attachment. It has been shown that RGD containing peptides with a proline at the carboxy end (RGDP) are inactive in cell attachment assays (Pierschbacher and Ruoslahti, 1987) and are excluded. The Geanfammer software was used to duster proteins into homologous families (Park and Teichmann, 1998). Preliminary analysis of the family classes has provided novel ORFs within a candidate duster as well as defining potential protein function.

Example 2

Cloning, Expression and Analysis of Predicted ORF Proteins

Materials and Methods

Growth of *Streptococcus pneumoniae*. *Streptococcus pneumoniae* were grown in Todd Hewitt broth (Difco) supplemented with 0.5% yeast extract. Bacteria were incubated at 350 C. in 5% $CO_2$ without shaking. Mid-log phase cultures ($OD_{550}$ approx 0.3) were harvested after approximately 4 hours incubation and cells pelleted by centrifugation (5,000×g) at 4° C.

Cloning and expression of predicted ORFs. The predicted ORFs were cloned and expressed in *E coli* Top 10 or BLR(DE3). Expression of each ORF was tested in both pBAD/Thio-TOPO (which contains an arabinose inducible promoter) and pCR-T7/NT-TOPO expression systems (Invitrogen, Carlsbad, Calif.). Gene specific primers were designed to amplify, by polymerase chains reaction (PCR), each selected ORF from *Streptococcus pneumoniae* CP1200 (Morrison et al., 1983) genomic DNA purified using the Wizard Genomic DNA purification kit (Promega, Madison, Wis.). The 5' primers were designed to exclude the predicted signal sequence (as predicted by SignalP) and the 3' primer was designed to either include the stop codon (pCR-T7) or exclude the stop codon (pBAD). ORFs were amplified in a standard polymerase chain reaction (200 μM each dNTP (Invitrogen), 200 μM each 5' and 3' gene specific primer, 1 μL stock of chromosomal DNA, 2.5U Pfu Turbo polymerase (Stratagene, LaJolla, Calif.) and 1×Pfu Turbo reaction buffer in a total volume of 50 μL). Overhanging A's were added to the PCR products by incubation for 10 minutes at 72° C. with 1U of Taq DNA polymerase (Roche Diagnostics, Indianapolis, Ind.). PCR products were cloned into the expression vectors and transformed into *E. coli* TOP10 following manufacturer's TOPO-TA cloning protocol (Invitrogen). Positive clones were identified by PCR using one gene specific primer and one vector specific primer to ensure correct orientation.

ORFs cloned into pCR-T7 were transformed into *E. coli* BL21 (DE3) for protein expression using the T7 promoter and those cloned into pBAD were kept in TOP10. Protein expression was determined by growing overnight cultures of the positive clones in 2 mL HySoy broth (DMV International Nutritional, Fraser, N.Y.) supplemented with 100 μg/mL ampicillin. These cultures were th n diluted 1:100 into fresh media and grown until $OD_{600}=1.0$. Protein expression was induced with either 2% arabinose (pBAD) or 0.1 mM IPTG (pCRT7). Three hours post-induction, the cells were harvested and protein expression determined by Western blot analysis of whole-cell lysates using either anti-express epitope (pCRT7) or anti-thio (pBAD) antibodies. The best expressing clone (pBAD or pCRT7) was used for protein production and purification.

Fourteen of the ORFs that did not express in either pCRT7 or pBAD were cloned into pET27b(+) (Novagen, Madison, Wis.). The ORFs were again amplified by PCR and cloned using standard molecular biology techniques into the NcoI and XhoI sites of pET27b(+). Clones were again screened by PCR, and plasmids with the correct insert were transformed into BL21(DE3) and expression tested as described for pCR-T7. Protein expression was determined by Western blot analysis using anti-HSV epitope antibody.

Purification of Soluble His-tag ORF Proteins. Protein was expressed from positive clones in 4×1L of media as described above. Cells were harvested by centrifugation, resuspended in 100 mL of Ni Buffer A (20 mM Tris, pH 7.5, 150 mM NaCl) and lysed by 2 passages through a French pressure cell at 16,000 psi (SLM Instruments, Inc., Rochester, N.Y.).

For soluble proteins, the cell debris was pelleted by centrifugation at ~9,000×g and the supernatant was loaded onto an iminodiaceticacid sepharose 6B (Sigma Chemical, St. Louis, Mo.) column charged with $Ni^{2+}$. Unbound proteins were washed from the column with Ni buffer A until $A_{280}$ of eluate reached a baseline. The bound protein was then eluted with Ni buffer A containing 300 mM imidazole (Sigma Chemical). Purity was estimated by SDS-PAGE.

Samples requiring further purification were concentrated and buffer exchanged over a PD-10 column (Amersham-Pharmacia Biotech, Piscataway, N.J.) equilibrated with buffer A (20 mM Tris, pH 8.0). The eluate was loaded onto a Q-sepharose High Performance (Amersham-Pharmacia Biotech) column and eluted with a 0-35% Buffer B (20 mM Tris, pH 8.0, 1M NaCl) gradient. Protein-containing fractions were determined by SDS-PAGE. All protein purification was done using an AKTA Explorer (Amersham-Pharmacia Biotech).

Isolation and Solubilization of Insoluble His-tag fusion Proteins. Bacterial cell pellets were suspended at a ratio of 5:1 (buffer volume:pellet wet weight) in 10 mM $NaPO_4$/150 mM NaCl/pH 7.0 with Complete Protease Inhibitor Cocktail containing EDTA (Roche Diagnostics GmbH, Mannheim, Germany). The cells were disrupted using a Microfluidizer (Microfluidics Corp., Newton, Mass.) and centrifuged at 21,900×g for 30 minutes at 4° C. The pellet, containing insoluble His-tag proteins, was subjected to a series of detergent extractions followed by a final solubilization step using 6M urea. The pellet was resuspended in 10 mM $NaPO_4$/150 mM NaCl/pH 7.0 containing Complete Protease Inhibitor Cocktail and 1.0% Triton X-100 (TX-100) using the same 5:1 ratio described above. The suspension was stirred at 4° C. for 30 minutes and centrifuged at 21,900×g for 20 minutes at 4° C. The supernatant was removed and stored at 4° C. for further analysis. The pellet was subjected to a second TX-100 extraction, as described, and the supernatant removed and stored at 4° C. for further analysis. The TX-100 pellet was then resuspended in 10 mM $NaPO_4$/150 mM NaCl /pH 7.0 containing Complete Protease Inhibitor Cocktail and 1.0% Zwittergent 3-14 (Z3-14) and stirred at 4° C. for a minimum of 1 hour. The suspension was centrifuged at 21,900×g for 20 minutes at 4° C. The supernatant was removed and stored at 4° C. for further analysis. The Z3-14 pellet was resuspended in 100 mM Tris-HCl/6M urea/pH 8.0 and stirred a minimum of 4 hours at room temperature. The suspension was centrifuged at 21,900×g for 20 minutes at 4° C. and the supernatant stored at 4° C. for further analysis.

Purification of Solubilized His-tag fusion proteins. Isolated extracts containing His-tag fusion proteins were identified as described by SDS-PAGE and/or Western blot analysis. Chromatography was carried out using POROS MC 20 micron metal chelate $Ni^{2+}$ media (Perseptive Biosystems, Framingham, Mass.) prepared according to the manufacturer. Protein extracts were loaded at approximately 5-10 mg of total protein per mL of column media.

For preparations in which the His-tag proteins were soluble in either the cytosolic fraction or detergent extractions by TX-100 or Z3-14, the material was applied directly to a MC 20 column equilibrated with a minimum of 3 column volumes of 10 mM $NaPO_4$/150 mM NaCl/pH 7.0 for cytosolic proteins, or the same buffer containing either 1.0% TX-100 or 1.0% Z3-14 for proteins isolated in the TX-100 and Z3-14 extractions respectively. For cytosolic material, unbound proteins were washed through the column with a minimum of 5 column volumes of equilibration buffer. For TX-100 or Z3-14 containing extracts, unbound proteins were washed through the column with equilibration buffer containing either 0.05% TX-100 or Z3-14, depending on the solubility characteristics of the particular protein. His-tag fusion proteins were eluted using a step gradient of 2 column volumes each of 25 mM, 50 mM, 125 mM, and 250 mM imidazole in 10 mM $NaPO_4$/150 mM NaCl/pH 7.0 containing either 0.05% TX-100 or 0.05% Z3-14. Fractions containing His-tag protein were identified by SDS-PAGE and pooled. Imidazole was removed by dialysis into an appropriate buffer. Protein concentration was determined by BCA assay (Pierce) and, if necessary, preparations were concentrated by either ultrafiltration using Centriprep YM-10 membranes (Millipore, Bedford, Mass.) or by applying the material to a smaller MC 20 column, under the conditions described, and eluting with 250 mM imidazole followed by dialysis. Protein purity was estimated by SDS-PAGE and scanning densitometry.

For preparations in which urea was used to denature and solubilize the protein, the material was diluted 3 fold with 100 mM Tris-HCl/0.05% TX-100/pH 7.5 to give a final urea concentration of 2 M. The material was applied to a MC 20 column equilibrated with a minimum of 3 column volumes of 100 mM Tris-HCl/0.05% TX-100/2 M urea/pH 7.5 and unbound proteins were washed through the column with a minimum of 5 column volumes of equilibration buffer. His-tag fusion proteins were eluted using a step gradient of 2 column volumes each of 25 mM, 50 mM, 125 mM, and 250 mM imidazole in 100 mM Tris-HCl/0.05% TX-100/2 M urea pH 7.5. Fractions containing His-tag protein were identified by SDS-PAGE and pooled. Imidazole and urea were removed, and the protein refolded by dialysis into an appropriate buffer containing 0.05% TX-100. If necessary, preparations were concentrated by either ultrafiltration using Centriprep YM-10 membranes (Millipore, Bedford, Mass.) or by applying the material to a smaller MC 20 column, under the conditions described, and eluting with 250 mM imidazole followed by dialysis. Protein purity was estimated by SDS-PAGE and scanning densitometry.

SDS-PAGE & Western Analysis. SDS-PAGE was carried out as described by Laemmli (Laemmli, 1970), using 10-20% (wt/vol) gradient acrylamide gels (Zaxis, Hudson, OH). Proteins were visualized by staining the gels with Simply Blue Safestain (Invitrogen Life Technologies, Carlsbad, Calif.). The gels were scanned with a Personal Densitometer SI (Molecular Dynamics Inc., Sunnyvale, Calif.) and purities were estimated using the Image Quant software (Molecular Dynamics Inc.).

Transfer of proteins to polyvinylidene difluoride (PVDF) membranes was accomplished with a semidry electroblotter and electroblot buffers (Owl Separation Systems, Portsmouth, N.H.). The PVDF membrane, containing the transferred protein, was blocked with 5% non-fat dry milk prepared in PBS (Blotto) for 30 minutes. The membrane was then probed with one of the following primary antibody preparations at the indicated dilution specific for the individual protein expression system: Invitrogen anti-Xpress (1:5000), Invitrogen anti-thioredoxin (1:2000), Novagen anti-HSV epitope (1:5000), Qiagen anti4X His (1:5000). The membrane was then washed with Blotto followed by Goat anti-mouse alkaline phosphatase conjugate (1:1500) as the secondary antibody (Biosource International, Camarillo, Calif.). Western blots were developed with 5-bromo4-chloro-indolylphosphate-nitroblue tetrazolium (BCIP/NBT) phosphatase substrate system (Kirkegaard and Perry Laboratories, Gaithersburg, Mich.).

Protein quantitation. Protein concentrations were estimated by the bicinchoninic assay (Pierce, Rockford, Ill.) with bovine serum albumin as the standard.

Production of anti-ORF sera in mice. Female Swiss Webster mice (Taconic Farms, Germantown, N.Y.) with ages 6 to 8 weeks old were immunized subcutaneously in the neck at weeks 0, 4, and 6 weeks with purified His tag protein. Two separate immunogenic compositions were prepared with each His-tag protein. One immunogenic composition was prepared with the protein formulated with STIMULON™ QS-21 and a second was prepared with the protein formulated with MPL™. Each dose for one group of mice contained 10 µg of purified protein and 20 µg STIMULON™ QS-21, While each dose for the second group of mice contained 10 µg of the same protein and 50 µg MPL™. Serum samples were collected at weeks 0, 4, 6 and 8. Mice were housed in a specific-pathogen free facility and provided water and food ad-libitum.

Pneumococcal whole-cell ELISAs. *Streptococcus pneumoniae* strains, either type 3 or type 14, were grown in Todd Hewitt broth (Difco) containing 100 µg/ml streptomycin at 35° C. without shaking. The bacteria were grown to mid-log phase ($OD_{550}$<1.0), and heat inactivated for 1 hour at 60° C. Bacteria were pelleted at 10,000×g and resuspended in PBS to an $OD_{550}$=0.1. Fifty-five µl of this suspension was then added to each well of 96-well Nunc plates and air dried at room temperature. Plates were stored at 4° C. until used.

Wells were blocked with 150 µl/well of PBS containing 5% (wt/vol) dry milk (blocking buffer) for 1 hour. Wells were washed 5 times with PBS in a Skantron washer, and mouse sera diluted in blocking buffer (100 µl/well) added. Plates were incubated at room temperature for 2 hours and unbound antibodies removed by washing 5 times with PBS in a Skantron washer. Bound antibodies were detected with 100 µl/well of peroxidase-labeled goat anti-mouse IgG (1:1,000 dilution of 1 mg/ml in PBS; KPL) at room temperature for 2 hours. Plates were washed with PBS as above, and developed with 100 µl/well ABTS (KPL) for 25 minutes at room temperature. The reactions were stopped with 100 µl/well of 1% SDS and the $OD_{405}$ of each well read on a VERSAmax microplate reader (Molecular Devices Corp., Sunnyvale, Calif.). Endpoint titers of each test serum were calculated as the inverse of the highest mean dilution giving an $OD_{405}$=0.1.

FACS analysis of *Streptococcus pneumoniae*. Strains type 3 and 19F were grown in Todd-Hewitt broth+0.5% yeast extract from frozen stocks of $OD_{600}$~1.0 cells. Incubation was at 37° C. for 3 to 4 hours without shaking. 2-3×10$^7$ cells, 100 µl of $OD_{600}$=0.5 for type3, and 50 µl for 19F, were pipetted into a 96-well microtiter plate and spun at 4000 rpm in an Eppendorf tabletop centrifuge for 5 minutes. Supernatant was aspirated and cells were resuspended in 95 µl PBS-0.5% BSA-0.1% gelatin. Five µl, primary antibody was added, mixed and left incubating on ice for 1 hour. Cells were pelleted as before, washed twice with 100 µl buffer and resuspended in 99 µl buffer. One pi goat anti-mouse secondary antibody conjugated to Alexa Fluor 488 (Molecular Probes, Eugene, Oreg.) was added to the samples, mixed and left incubating on ice for 30 minutes. Cells were washed as before and resuspended in 100 µl buffer. Before analyzing on the FACSVantageSE unit, samples were diluted to 1 ml with buffer. Samples were read on a Becton Dickinson FACSVantage unit with an Enterprise II laser. Excitation was at 488 nm and emission was detected with a photomultiplier tube using a 530/30 filter. Week 0 antisera were run as background control for the week 8 antisera.

Comparison of message from cells grown in vitro and in vivo. Messenger RNA (mRNA) levels for specific transcripts can be examined by creating a double stranded cDNA from the mRNA using reverse transcriptase. This cDNA is then amplified using standard PCR conditions. The resulting amplification products are thus indicative of the message produced. This technique is useful for comparing the expression of specific transcripts under varying environmental conditions, such as growth in culture flasks versus growth in vivo.

Preparation of RNA from cells grown in vitro. In vitro grown *Streptococcus pneumoniae* serotypes were grown to log phase in 60 ml THB –0.5%YE at 37° C. with 5% $CO_2$. Bacterial cells were harvested by centrifugation at 1000×g for 15 minutes at 4° C. The supernatant was aspirated and the cells were resuspended in 1 ml RNAlater (Ambion, Austin, Tex.) and stored for >1 hour at 4° C. The cells were then centrifuged in a microfuge for 5 minutes at 8000×g. The supernatant was aspirated and the cells were resuspended in 100 µl 10% deoxycholate (DOC). 1100 µl of RNAZOL B (Tel-Test, Inc) were then added and the suspension mixed briefly by inversion. 120 µl of $CHCl_3$ were then added, the sample mixed by inversion and then centrifuged in a microfuge at full speed for 10 minutes at 4° C. The aqueous layer was removed and the RNA was precipitated by addition of an equal volume of 2-propanol. The RNA was incubated at 4° C. for >1 hour and then centrifuged in a microfuge at full speed for 10 minutes at room temperature. The supernatant was aspirated and the RNA was washed with 75% ETOH and recentrifuged for 5 minutes. The supernatant was aspirated and the RNA was resuspended in 50-100 µl nuclease-free water. DNA was removed from the RNA by treating the sample with RNAse-free DNAase (DNA FREE, Ambion) for 20 minutes at 37° C., followed by inactivation of the enzyme by addition of the DNA FREE chelator. The purity and yield of the RNA was assessed by measuring the absorbance at 260 nm and 280 nm. Absorbance ratios were typically 1.9-2.0. RNA was stored at –70° C.

Preparation of RNA from cells grown in vivo. In vivo grown *Streptococcus pneumoniae* serotypes were harvested from sealed dialysis tubing incubated in the peritoneal cavities of Sprague-Dawley rats as described by Orihuela et al. (2000). Log phase. *Streptococcus pneumoniae* cells were prepared as described above and resuspended to 10$^6$ cfu/ml in RPMI media (Celltech) supplemented with 0.4% glucose. One ml of the cell suspension was sealed in a PVDF dialysis membrane with a 80,000 $M_w$ cutoff (SprectraPor). Two such bags were implanted intraperitoneally in 400 g Sprague Dawley rats (Taconic). The bags remained in the rats for 22 hours, after which the rats were terminated and the bags were harvested. RNA was prepared from the intraperitoneally grown cells as described above.

RT-PCR to examine message levels. Specific message for each candidate gene was amplified out from RNA prepared from both in vitro and in vivo grown cells using RT-PCR. For each reaction, 0.5 µg RNA was incubated with 0.25 µM of the reverse mining primer for 3 minutes at 75° C., then cooled on ice and transferred to 44° C. The message was reverse transcribed using the RETROscript (Ambion) kit according to the manufacturer's directions. ReddyMix (AB-gene) was used according to the manufacturer's directions to amplify each message from 2-5 μl of the sample, using 0.25 μM of the above reverse primer and the forward mining primer. Following amplification, 10 μl of the amplified product was electrophoresed on a 1% agarose gel.

Results

Cloning of ORFs into expression vectors. Fifty-nine ORFs were selected for cloning and expression based on prediction of surface exposure from genomic analysis as described above. These ORFs were amplified by PCR and cloned into the expression vectors as described in Materials and Methods. The ORFs were cloned into pBAD/Thio-TOPO and pCR-T7/NT-TOPO. Both vectors fuse a hexa-histidine tag and a unique epitope to facilitate purification and identification by western blot respectively. The pBAD vector also fuses a thioredoxin moiety to the cloned protein to enhance solubility.

Expression of ORFs in E. col. The genes encoding all 59 ORFs were induced in the appropriate host E. coli strains and examined for expression by SDS-PAGE and western blot analysis of whole cell extracts. Of the 59 ORFs, a total of 24 (41%) were expressed at detectable levels. Fourteen of the ORFs that did not express in either of the expression vectors were cloned into pET27b(+) which fuses a hexahistidine tag to the C-terminus and a PelB leader sequence at the N-terminus of the protein. One of the 14 ORFs cloned into pET27b(+) expressed protein.

Purification of Expressed ORF Proteins. All of the expressed ORFs contained a 6×His motif to aid in purification. Initial purification of all of the proteins was done using a Ni containing resin according to manufacturer's directions. Twenty of the expressed ORF proteins were purified to acceptable levels of homogeneity for immunization studies using this affinity purification (Table 17). Specific purification conditions used are detailed in Materials and Methods and in Table 17. Thirteen of the 20 ORF proteins were used to immunize mice and obtain antisera specific for the expressed protein.

TABLE 17

Purification of Expressed S. pneumoniae ORF Proteins

| ORF # | [Protein] mg/ml | Total Protein mg | Purity % | Final Buffer | "PSORT" PREDICTED Location | Location in E. coli |
|---|---|---|---|---|---|---|
| 75 | 0.52 | 6.8 | 94% | PBS/1 mM EDTA pH 7.4 | Outer membrane | Cytosol |
| 2615 | 0.42 | 16.8 | 80% | PBS/1 mM EDTA pH 7.4 | Outer membrane | Cytosol |
| 3039 | 0.53 (0.14) | 2.91 | 82% | 0.1 MTris/150 mM NaCl/ 0.05% Zw3-14/1 mM EDTA pH 8.0 | Outer membrane | Inclusion Bodies |
| 1143 | 1.4 | 196 | 92% | PBS/0.05% tx-100/ 1 mM EDTA pH 7.4 | Inner membrane | Inclusion Bodies |
| 1835 | 0.5 (0.2) | 10.5 | 91.3% | PBS/0.05% tx-100/ 1 mM EDTA pH 7.4 | Inner membrane | Inclusion Bodies |
| 1568 | 1.0 | 5.0 | >85% | PBS/0.05% tx-100/ 1 mM EDTA pH 7.4 | Inner membrane | Inclusion Bodies |
| 2271 | 4.9 | 122.5 | >90% | PBS, pH 7.4 | Inner Membrane | Cytosol |
| 2621 | 1.5 | 4.5 | >90% | PBS, pH 7.4 | Inner Membrane | Cytosol |
| 1104 | 2.0 | — | 85-90% | PBS, pH 7.4 | Outer Membrane | Cytosol |
| 935 | 0.1 | .5 | 85% | 50 mM Glycine-NaOH/ 150 mM NaCl/0.05% Z3-14 pH 10.0 | Outer membrane | Inclusion Bodies |
| 3361 | 1.67 | 3.34 | 98% | PBS/1 mM EDTA pH 7.4 | Inner membrane | Cytosol |
| 339 | 0.91 (0.91) | 127.4 (27.3) | 93.2% (80.8%) | PBS/0.05% tx-100/ 1 mM EDTA pH 7.4 | Inner Membrane | Inclusion Bodies |
| 2322 | 0.55 (0.23) | 2.5 (0.92) | 90% | BS/0.05% tx-100/ 1 mM EDTA pH 7.4 | Inner Membrane | Inclusion Bodies |
| 1476 | 1.2 (0.6) | 9.6 | >80% | PBS/0.05% tx-100/ 1 mM EDTA pH 7.4 | Inner Membrane | Inclusion Bodies |
| 3115 | 0.2 (0.5) | 2.8 | >85% | PBS/0.05% tx-100/ 1 mM EDTA pH 7.4 | Inner Membrane | Inclusion Bodies |
| 132 | 4.6 | 460 | 95% | PBS pH 7.4 | — | Cytosol |
| 3386 | 3.1 | 27 | 85% | PBS pH 7.4 | Inner Membrane | Cytosol |
| 2112 | 0.6 | 1.8 | 85% | PBS pH 7.4 | Inner Membrane | Cytosol |
| 916 | 0.26 | 1.3 | >85% | PBS 0.05% Tx-100 pH 7.4 | — | Inclusion Bodies |
| 3373 | 0.97 | 1.9 | 84% | PBS 0.05% Z3-14 pH 7.4 | Inner Membrane | Inclusion Bodies |

Expression of ORF proteins in *Streptococcus pneumoniae* whole cell lysates To determine if the ORFs are being expressed in *Streptococcus pneumoniae*, whole cell lysates of in vitro grown cells were probed with the antisera in Western blot analysis. Each antiserum was reactive with the purified recombinant protein as a positive control (data not shown). Whole cell lysates from *Streptococcus pneumoniae* strains type 3, type 14, and type 19F were examined in Western blot, and the results are summarized in Table 18. Proteins from three of the ORFs were undetectable or barely detectable in all of the strains tested. Proteins from eight of the ORFs were expressed in at least 2 of the strains, while proteins from two ORFs were detected in only one of the three strains examined. These results demonstrate that the majority of the proteins from these ORFs were expressed in late log, early stationary phase *Streptococcus pneumoniae*, and that some strains may not express detectable amounts of each ORF at the time point examined.

described above. The results of the analyses are shown in Table 18. *Streptococcus pneumoniae* type 3 cells showed a 9-fold increase in geometric mean fluorescence intensity when labeled with antiserum to ORF 2621 (SEQ ID NO:363). A less intense fluorescence intensity was detected with antisera directed against the proteins of ORF 1835 (SEQ ID NO:315), ORF 2271 (SEQ ID NO:343), ORF 75 (SEQ ID NO:218), ORF 1143 (SEQ ID NO:285), and ORF 1104 (SEQ ID NO:282). Nine of the antisera tested did not show any detectable surface reactivity with the *Streptococcus pneumoniae* type 19F strain. This may be due to the level of sensitivity of the technique or the capsule of 19F covering the surface exposed proteins more completely under the conditions tested.

Analysis of ORF mRNA expression in vitro vs. in vivo. Forward and reverse mining primers were used to amplify the full length message for several ORFs, identified by mining algorithms as potential vaccine antigens (Example

TABLE 18

Whole Cell ELISA and Western Blot Expression Data for *S. pneumoniae* ORFs

| Vaccine (10 µg) | Adjuvant (20 µg) | Whole Cell ELISA | | Western Blot Expression In vitro | | | FACS Analysis Type | |
|---|---|---|---|---|---|---|---|---|
| | | Type 3 | Type 14 | Type 3 | Type 14 | Type 19F | Type 3 | 19F |
| 2615 | QS21 | <200 | <200 | − | − | − | − | − |
| 3039 | QS21 | <200 | <200 | + | ++ | ++ | − | − |
| 75 | QS21 | 256 | <200 | +++ | +++ | +++ | + | − |
| 1568 | QS21 | 4,018 | <200 | ++ | +++ | +++ | − | − |
| 1143 | QS21 | 779 | <200 | + | ++ | + | + | − |
| 1835 | QS21 | 202 | <200 | − | +/− | − | + | − |
| 2271 | QS21 | 442 | <200 | +++ | +++ | +++ | + | − |
| 2621 | QS21 | 739 | <200 | ++ | + | − | ++ | − |
| 1104 | QS21 | 409 | <200 | +++ | +++ | +++ | + | − |
| 339 | QS21 | <200 | <200 | − | +/− | − | − | ND |
| 2322 | QS21 | <200 | <200 | − | − | +/− | − | ND |
| 3361 | QS21 | <200 | <200 | − | + | + | + | ND |
| 935 | QS21 | <200 | <200 | − | − | − | − | ND |
| Standard | | ~45,000 | ~10,000 | ND | ND | ND | | |

Surface exposure of ORF proteins: Whole Cell ELISA. The 13 antisera against the recombinant ORF proteins were tested for surface reactivity by whole cell ELISA against two strains of *Streptococcus pneumoniae*, type 3 and type 14. The results are shown in Table 18. Seven of the 13 antisera gave detectable whole cell titers against type 3 *Streptococcus pneumoniae*, while none of them gave detectable titers against the type 14 strain. When anticapsular serum was tested against the homologous capsular serotype, the titer against the type 14 strain was much lower than that there against the type 3 strain (see row labeled "standard" in Table 18). This result indicated that there might have been sensitivity issues with the type 14 whole cell ELISA, because the Western blot data clearly demonstrate that type 14*Streptococcus pneumoniae* do express the majority of the proteins of the ORFs (Table 18). The whole cell ELISA titers of antiserum against the proteins of ORF 75 NO:218), ORF 1104 (SEQ ID NO:282), ORF 2621 (SEQ ID NO:363), ORF 1588 (SEQ ID NO:306), ORF 1143 (SEQ ID NO:285), ORF 2271 (SEQ ID NO:343), and ORF 1835 (SEQ ID NO:315) ranged from slightly above background to 20 times above background. These results indicate that these antisera detect at least some surface exposed epitopes for these ORFs.

Surface exposure of ORF proteins: FACS Analysis. The polyclonal antisera against the proteins from ORFs 2615, 3039, 75, 1568, 1143, 1835, 2271, 2621, 1104, 339, 2322, 3361 and 935, were analyzed for surface reactivity with whole *Streptococcus pneumoniae* cells by FACS analysis as 1), from type 3 and type 14 cells grown under in vitro and in vivo conditions. In three of the four ORFs examined, message was detected in both in vitro and in vivo grown cells. For ORFs 1104 (SEQ ID NO:282) and 1568 (SEQ ID NO:306), the detection of message correlated with the presence of an immunoreactive band on a Western blot of whole cell lysates for the same serotypes. However for ORF 2322 (SEQ ID NO:345), message was detected in both serotype 3 and 14, but no immunoreactive band was present for those serotypes, indicating that either the protein was secreted or that the antibodies generated by the recombinant protein did not recognize the native protein. No message was detected for ORF 935 (SEQ ID NO:265) in either growth condition, which correlates with the absence of an immunoreactive band on a Western blot. In a separate experiment, message of the expected size was detected from RNA made from serotype 14 grown in vitro for ORFs 1143 (SEQ ID NO:285), 1475 (SEQ ID NO:298), 3039 (SEQ ID NO:380), 2271 (SEQ ID NO:343), 3115 (SEQ ID NO:388) and 3361 (SEQ ID NO:402)(data not shown).

Discussion

Prediction of surface exposure is a critical step for genomic mining efforts for identifying candidate antigens. The algorithms utilized herein have been shown in the past to have predictive value for selecting candidate ORFs to examine. The results shown here demonstrate the utility of the algorithms for *Streptococcus pneumoniae* and that they represent an advance over the previously utilized algorithms. Here, 7 out of 13 proteins from ORFs tested are shown to be surface exposed by at least two of the techniques employed. These techniques, including whole cell ELISA and FACS analysis of whole *Streptococcus pneumoniae* cells, have different strengths for detection of surface exposed epitopes of proteins. Whole cell ELISA utilizes fixed cells bound to a solid phase support, while FACS analysis uses living *Streptococcus pneumoniae* in liquid suspension. However, the whole cell ELISA is more sensitive than the FACS analysis, and can thus give a more quantitative determination of surface exposed epitopes at low levels of antibody binding. It is not known why the protein of ORF 2621 was so strongly positive in the FACS analysis, yet had a comparatively low whole cell ELISA titer (Table 18). This may be the result of differing growth conditions or the differing detection conditions employed in each of the assays. However, the data are consistent in that the proteins from 6 ORFs that are noted to have surface exposed epitopes all are positive in both assays employed.

The lack of detection of surface exposure in the 19F strain by FACS is puzzling. None of the ORFs had detectable epitopes on the surface of the 19F strain in the FACS technique used, but the majority of them were well expressed in whole cell lysates from this strain (Table 18). This may be due to the unique capsular material of 19F covering the surface exposed proteins, or that the FACS technique is less sensitive against type 19F cells. It is also possible that none of the proteins tested have surface exposed epitopes in type 19F, but this is extremely unlikely, since even antiserum against another known candidate (PhpA protein) (Zhang et al., 2001) that is surface exposed produced much less detectable surface antibody binding in FACS analysis as compared to type 3 cells (data not shown).

The failure to detect surface reactive antibody in the type 14 whole cell ELISA (Table 18) was also most likely due to the growth of the cells or the assay conditions, because the standard sera employed gave a much lower titer than normally observed.

The RT-PCR data serve to reinforce the potential of the candidate proteins from these ORF's. The data show that *Streptococcus pneumoniae* grown either in vitro or in vivo produce mRNA specific for the ORFs examined. Since it is known that the ORFs are expressed in vitro, it is likely that they are also expressed in vivo as well. Experiments are in progress to confirm this using whole cell lysates from in vivo grown cells.

Not every ORF analyzed could be shown to be expressed in *Streptococcus pneumoniae*. For example, a protein from ORF 935 was not detected by Western blot analysis, whole cell ELISA (Table 18), or RT-PCR (data not shown). It may be that ORF 935 is only expressed under "real" in vivo conditions or that the sequencing of the region is incorrect and the expressed protein is out of frame with the true protein produced by *Streptococcus pneumoniae*.

Example 3

*Streptococcus Pneumoniae* Proteome Analysis

Materials and Methods

Bacteria and media. *S. pneumoniae* type III (ATCC #6303) was obtained from the American Type Culture Collection, Manassas, Va. *S. pneumoniae* type 19F was obtained from Dr. Gerald Schiffman, State University of New York, Brooklyn, N.Y. A glycerol stock plate on Tryptic Soy Agar II (TSA II)/5.0% sheep blood plate (Becton Dickinson Microbiology Systems, Cockeysville, Md.) was prepared and incubated overnight, at 37° C. in the presence of 5.0% $CO_2$. Cells from each plate were transferred to 20 ml of Todd-Hewitt Broth/0.5% Yeast Extract (THY) and incubated overnight at 37° C. with gentle shaking (10 rpm) in the presence of 5.0% $CO_2$. For type 3, the culture was then diluted 10 fold with 100 ml of THY. For type 19F, the culture was then diluted 40 fold with 200 ml of THY. Both of these diluted cultures were subsequently incubated under the above conditions. Type 19F required 9 h incubation time to reach a concentration of $1 \times 10^9$ cells/ml. Type 3 was incubated overnight and its concentration was not determined.

Isolation of membrane fraction. The bacterial cultures were spun down and washed with $PBS/MgSO_4$ (30 mM sodium phosphate/S150 mM NaCl/1 mM $MgSO_4$, pH 6.8). The pellets were resuspended in 4 ml of $PBS/MgSO_4$ containing 5 µg Lysozyme (Sigma Chemical Co., St. Louis, Mo.), and 400 µg Mutanolysin (Sigma). The samples were incubated at 37° C. for 1 hour with shaking. After the incubation, ~300 units of RNAse Cocktail™ (Ambion Inc., Austin, Tex.) was added to each sample. The samples were centrifuged at low speed using a tabletop centrifuge (2.5 k rpm, 10 min, at 4° C.). The supernatant was subsequently spun at high speed to pellet the membrane fractions using a Beckman (Beckman Instruments, Inc., Palo Alto, Calif.) Model L8-70M Preparative Ultracentrifuge (60Ti rotor, at 40 k rpm, 4° C., 1 h). The supernatant was removed and the membrane pellet was washed with $PBS/MgSO_4$.

Trypsin digestion of excised SDS-PAGE gel bands. Mini SDS-PAGE gels (10 cm×10 cm) were run with precast 10-20% (w/v, acrylamide) gradient gels (Zaxis, Hudson, Ohio) at 200 V. The See Blue molecular weight standard used was obtained from Invitrogen, Carlsbad, Calif. The gels were stained with Simply Blue Safestain, a colloidal Coomassie Blue G250 stain (Invitrogen) as per manufacturer's instructions. Each sample lane, in its entirety, was cut into 15 different bands. For each sample, bands representing identical molecular weight areas of the gel from three sample lanes, run next to each other, were collected together for further processing. The gel slices were washed twice with 0.5 ml of 50% (v/v) aqueous HPLC grade acetonitrile (Burdick & Jackson, Muskegon, Mich.) for 5 min with gentle shaking and stored frozen at −20° C. following removal of the wash liquid. Frozen gel bands were thawed and cut into 1 mm cubes and subjected to in-gel trypsin digestion using a DigestPro robot (ABIMED Analysen-Technik GmbH, Langenfeld, Germany). In the configuration used, up to 30 samples could be processed simultaneously. The automated protocol consisted of the following steps in order: reduction of the protein in the gel bands with dithiothreitol, alkylation with iodoacetamide, digestion with trypsin and elution of the peptides. Sequencing Grade Modified Trypsin obtained from Promega Corporation, Madison, Wis. was used. This trypsin is highly specific for hydrolysis of peptide bonds at the carboxylic sides of lysine and arginine residues. It is modified by reductive methylation to make it extremely resistant to autolysis, which can generate pseudotrypsin with chymotrypsin-like specificity. Specificity is further improved by treatment with L-1-chloro-3-tosylamido phenylbutan-2-one (TPCK) followed by affinity purification. The peptide digests were collected, dried using a SpeedVac (Thermo Savant, Holbrook, N.Y.) to ~10 µl, and subsequently diluted to 50 µl with 0.1 M acetic acid. Samples were transferred to plastic autosampler vials, sealed, and injected using a 5 µl sample loop.

Microcapillary LC-Mass Spectrometry. Mass spectral data were acquired on a Thermo Finnigan LCQ DECA quadrupole ion trap mass spectrometer (Thermo Finnigan, San Jose, Calif.) equipped with a microcapillary reversed-phase HPLC/micro-electrospray interface. Peptide extracts were analyzed on an automated microelectrospray reversed phase HPLC. The microelectrospray interface consisted of a Picofrit fused silica spray needle, 10 cm length by 75 µm ID, 15 µm orifice diameter (New Objective, Cambridge, Mass.) packed with 10 µm $C_{18}$ reversed-phase beads (YMC, Wilmington, N.C.) to a length of 10 cm. The Picofrit needle was mounted in a fiber optic holder (Melles Griot, Irvine, Calif.) held on a base positioned at the front of the mass spectrometer detector. The rear of the column was plumbed through a titanium union to supply an electrical connection for the electrospray interface. The union was connected with a length of fused silica capillary (FSC) tubing to a FAMOS autosampler (LC-Packings, San Francisco, Calif.) that was connected to an HPLC solvent pump (ABI 140C, Perkin-Elmer, Norwalk, Conn.). The HPLC solvent pump delivered a flow of 50 µL/min. which was reduced to 250 nl/min. using a PEEK microtight splitting tee (Upchurch Scientific, Oak Harbor, Wash.), and then delivered to the autosampler using an FSC transfer line. The HPLC pump and autosampler were each controlled using their internal user programs.

Five microliters of the tryptic digest was separated using the $C_{18}$ microcapillary HPLC column eluting directly into the orifice of the mass spectrometer. Peptides were separated at a flow rate of 250 nl/min using a 50 minute gradient of 4-65% (v/v) acetonitrile in 0.1 M acetic acid. Peptide analyses were conducted on the LCQ-DECA ion trap mass spectrometer operating at a spray voltage of 1.5 kV, and using a heated capillary temperature of 140° C. Data were acquired in automated MS/MS mode using the data acquisition software provided with the instrument. As the peptides elute from the HPLC into the mass spectrometer, they are detected and fragmented in a data dependent manner using "dynamic exclusion". In this technique, the ion trap cycles between full scan and collision induced dissociation (CID) mode, first detecting candidate ions, and then collecting them for fragmentation. Decisions about which ions are going to be fragmented are performed by the instrument "on the fly". The ions, once collected, are then added to an exclusion list and are rejected for a window of two minutes. This technique allows the instrument to distribute its time efficiently when presented with analytes of very high complexity. The operation can result in the collection of as many as 1000 to 2000 fragmentation (CID) spectra in a single run. The acquisition method included 1 MS scan (375-600 m/z) followed by MS/MS scans of the top 2 most abundant ions in the MS scan. The instrument then conducted a second MS scan (600-1000 m/z) followed by MS/MS scans of the top 2 most abundant ions in that scan. The dynamic exclusion and isotope exclusion functions were employed to increase the number of peptide ions that were analyzed (settings: 3 amu=exclusion width, 3 min=exclusion duration, 30 sec=pre-exclusion duration, 3 amu=isotope exclusion width). For the current experiment involving 30 samples, the data was collected in a completely automated fashion over 48 hours using the autosampler.

Sequence database search for identification of proteins from CID spectra. Automated analysis of MS/MS data was performed using the SEQUEST computer algorithm incorporated (Eng, McCormack and Yates, 1994) into the Finnigan Bioworks data analysis package (ThermoFinnigan, San Jose, Calif.) using the protein sequence databases described below. SEQUEST is highly computation intensive, the searches for this study were performed on a dedicated 12×600 MHz PC cluster. Peptide matches with Xcorr values greater than 2.0 were loaded into a database for further computational analysis followed by manual verification of the data where necessary (as described below).

Results and Discussion

Proteomics Based Approach

The term 'proteome' has been defined as the proteins expressed by the genome of an organism or tissue. One of the primary goals of analysis of the proteome or proteomics involves identification of proteins in a large-scale high-throughput format. Bacterial membrane preparations constitute a very important source for surface localized proteins, which are likely candidate antigens. A proteomics based approach was taken to identify the protein components of the complex mixture of proteins contained in the membrane fraction of *Streptococcus pneumoniae*. The study of membrane associated proteins offers a very specific and significant challenge for proteomics. The detergents required to keep these proteins in aqueous solution usually interfere with analytical methods. During two-dimensional (2-D) gel electrophoresis, which has been widely used for the analysis of soluble proteins, severe quantitative loss of membrane proteins is often observed. The problem is more severe when immobilized pH gradients are used in the first dimension. To minimize such solubility problems with membrane preparations from some other bacteria, several sample preparations, as well as some novel zwitterionic detergents were tested; all of which were shown to improve the analysis of membrane proteins by 2-D gel electrophoresis. However, applicants believe their success in identifying the major set of outer membrane proteins was quite limited. In view of this, a novel combination of a very simple and a very complex method for identification of the membrane proteome component of *Streptococcus pneumoniae* has been applied, as described below.

In this approach, the membrane preparation was first separated by sodium dodecyl sulfate polyacrylamide gel electrophoresis (SDS-PAGE) using a mini gel format, followed by staining of the gel with a colloidal Coomassie blue stain. Fifteen gel bands containing the entire sample lane were excised and the bands digested individually with trypsin. The tryptic peptides were analyzed using microcapillary reversed-phase liquid chromatography-micro-electrospray tandem mass spectrometry (LC-MS/MS) on a Finnigan LCQ Deca quadrupole ion trap mass spectrometer. Tandem mass spectrometry (MS/MS) has been shown to be a powerful approach to analyze proteins (Eng, McCormack and Yates, 1994). In the first step, MS/MS uses a mass analyzer to separate a peptide ion from a mixture of ions, then uses a second step or mass analyzer to activate and dissociate the ion of interest. This process, known as collision-induced dissociation (CID), causes the peptide to fragment at the peptide bonds between the amino acids, and the fragmentation pattern of a peptide is used to determine its amino acid sequence. The SEQUEST computer algorithm (Eng, McCormack and Yates, 1994) was used to search the uninterpreted experimental fragmentation spectra against protein or translated nucleotide sequence databases to identify the proteins present in each gel band. SEQUEST conceptually digests protein sequences in a database into tryptic peptides and then models them into simulated CID spectra using the known rules of peptide fragmentation. SEQUEST then compares these simulated CID spectra against the experimental spectra and returns a list of probable peptide sequences matching the raw data along with different parameters representing the fidelity of the match. For peptides above roughly 800-900 Dalton in size, a single spectrum can uniquely identify a protein.

To obtain sequence information on multiple peptides from the complex mixture generated by trypsin digestion of the SDS-PAGE gel bands, a reversed phase chromatography system was coupled to an electrospray ion trap mass spectrometer. In this system, it is known that high sensitivity (down to sub-femtomole levels) can be attained by minimizing both flow rate and column diameter to concentrate the elution volume and direct as much of the column effluent as possible into the orifice of the mass spectrometer. To maximize the coverage of proteins present in the sample, the data-dependent acquisition feature of the ion trap was employed. Dynamic exclusion was used to prevent reacquisition of tandem mass spectra of ions once a spectrum had been acquired for a particular m/z value. Use of these data-dependent features dramatically increased the number of peptide ions that were selected for CID analysis.

The LC-MS/MS data acquisition conditions described above typically resulted in fragmentation data for more than 2000 peptide ions for each run. Using the SEQUEST algorithm, this data was correlated against two protein sequence databases. The first one, SnA6F6, contained open reading frames obtained from translation of *Streptococcus pneumoniae* type 4 genome sequence (TIGR4) in all six reading frames with the smallest peptide containing six amino acid residues. The second one, nr, is a non-redundant GenBank protein sequence database. SEQUEST search conditions used trypsin selectivity for both of the searches. The SnA6F6 search allowed a differential search of +16 Dalton for methionine residues to account for peptides displaying oxidation of methionine.

Candidate matches identified by SEQUEST were confirmed using the following procedure. For each peptide, SEQUEST computes a Xcorr value from cross correlation of the experimental MS/MS spectrum with the candidate peptides in the sequence database. The Xcorr is a measure of the similarity of the experimental MS/MS data to that generated from the sequence database. Peptide matches with Xcorr values greater than 2.0 were selected for further analysis and loaded on to an in-house developed system for analysis of SEQUEST data using the commercially available Oracle® relational database system. Since the SEQUEST output is quite complex, applicants incorporated a new scoring algorithm in Oracle® to calculate a match score for each protein identified as follows:

Protein Score=$n\Sigma$(Xcorr/rank)

where the rank is that assigned by SEQUEST for each peptide sequence identified from a specific protein sequence in the database and n is the number of unique peptides identified for that protein, since the same peptide may be identified multiple times in an LC-MS/MS experiment. The fragmentation spectra for all moderate or weak assignments by the software used were checked manually by direct examination of the CID spectra for reasonable signal/noise ratio, and the list of matched ions was also examined for reasonable continuity. Generally three or more spectra converging with reasonable Protein Score (usually >25) or Xcorr values (usually >2.5) onto a single database entry constitutes a convincing identification.

The rationale behind the experimental proteomics approach for characterization of membrane associated proteins of *Streptococcus pneumoniae* was that the single SDS-PAGE step circumvented the solubility complications associated with isoelectric focusing in 2-D gel electrophoresis. It also offered a simple fractionation of the membrane preparation according to molecular weight that reduced the complexity of the samples subjected to LC-MS/MS analysis. The combination of these analytical techniques allowed us to separate and obtain sequence information of multiple peptides with high sensitivity over a large concentration range and identify the corresponding proteins by correlation with sequences in databases. As part of this study, a method for the isolation of membrane preparations from *Streptococcus pneumoniae* was also developed. This involved enzymatic digestion of *Streptococcus pneumoniae* cell walls with mutanolysin and lysozyme in a hypotonic buffer followed by differential centrifugation. The twenty-eight ORFs representing surface exposed proteins were also identified by the proteomic approach and are presented in Table 11. The ORFs representing membrane associated proteins and identified by the proteomic approach are presented in Table 12. Table 14 contains all the open reading frames identified from the SnA6F6 database representing the TIGR4 genomic sequence. Table 14 also contains proteins identified from the nr database search which do not originate from the TIGR4 genome.

Combination of Genomics and Proteomics Approaches

The ORFs identified by proteomics represent surface localized, surface exposed or membrane associated proteins of *Streptococcus pneumoniae*. Those twenty-eight ORFs that support the putative surface exposed ORFs identified by genomics approaches (i.e., Tables 1-10) are listed in Table 11 and provide further evidence of surface localization of these candidates. The 161 novel ORFs identified by proteomics as membrane associated are listed in Table 12.

Example 4

Immunogold Labeling of *Streptococcus pneumoniae* and Low Voltage Scanning Electron Microscopy Surface exposure of proteins on *Streptococcus pneumoniae* may also be assessed by immunogold labeling of whole bacteria and electron microscopy. Bacteria cells are labeled as previously described (Olmsted et al., 1993). Briefly, late-log phase bacterial cultures are washed twice, and resuspended to a concentration of $1\times10^8$ cells/ml in 10 mM phosphate buffered saline (PBS) (pH 7.4) and placed on poly-L-lysine coated glass coverslips. Excess bacteria are gently washed from the coverslips and unlabeled samples are placed into fixative (2.0% glutaraldehyde, in a 0.1 M sodium cacodylate buffer containing 7.5% sucrose) for 30 min. Bacteria to be labeled with colloidal gold are washed with PBS containing 0.5% bovine serum albumin, and the pre-immune or hyper-immune mouse polyclonal antibody prepared above applied for 1 hour at room temperature. Bacteria are then gently washed, and a 1:6 dilution of goat anti-mouse conjugated to 18 nm colloidal gold particles (Jackson ImmunoResearch Laboratories, Inc., West Grove, Pa.) applied for 10 min at room temperature. Finally, all samples are washed gently with PBS, and placed into the fixative described above. The fixative is washed from samples twice for 10 min in 0.1 M sodium cacodylate buffer, and postfixed for 30 min in 0.1 M sodium cacodylate containing 1% osmium tetroxide. The samples are then washed twice with 0.1 M sodium cacodylate, dehydrated with successive concentrations of ethanol, critical point dried by the $CO_2$ method of Anderson (Anderson, 1951) using a Samdri-780A (Tousimis, Rockville, Md.), and coated with a 1-2 nm discontinuous layer of platinum. *Streptococcus pneumoniae* cells are viewed with a LEO 1550 field emission scanning electron microscope operated at low accelerating voltages (1-4.5 keV) using a secondary electron detector for conventional topographical imaging and a high-resolution Robinson backscatter detector to enhance the visualization of colloidal gold by atomic number contrast.

Example 5

In Vitro Opsonphagocytosis Analysis

An in vitro opsonic reaction, that may mimic the in vivo reaction, is conducted by incubating together a mixture of Streptococcus pneumoniae cells, heat inactivated human serum containing specific antibodies to the pneumococcal strain, and an exogenous complement source. Opsonophagocytosis proceeds during incubation of freshly isolated human polymorphonuclear cells (PMN's) and the antibody/complement/pneumococcal cell mixture. Bacterial cells that are coated with antibody and complement are killed upon opsonophagocytosis. Colony forming units (cfu) of surviving bacteria that escape from opsonophagocytosis are determined by plating the assay mixture. Titers are reported as the reciprocal of the highest dilution that gives $\geq 50\%$ bacterial killing, as determined by comparison to assay controls. Specimens which demonstrate less than 50% killing at the lowest serum dilution tested (1:8), are reported as having an OPA titer of 4. The highest dilution tested is 1:2560. Samples with $\geq 50\%$ killing at the highest dilution are repeated, beginning with a higher initial dilution.

The present method is a modification of Gray's method (Gray, B. M. 1990). The assay mixture is assembled in a 96-well microtiter tissue culture plate at room temperature. The assay mixture consists of 10 µL of test serum (a series of two-fold dilutions) heated to 56° C. for 30 minutes prior to testing, 10 µL of preclostral bovine serum (complement source) having no opsonic activity for the bacterial test strain, and 20 µL of buffer containing 2000 viable Streptococcus pneumoniae organisms. This mixture is incubated at 37° C. without $CO_2$ for 30 minutes with shaking. Next, 40 µL of human PMNs, freshly prepared from heparinized peripheral blood by dextran sedimentation and Percoll density centrifugation, suspended in buffer at a concentration of $1\times 10^6$/mL is added. The assay plate(s) are then incubated at 37° C. for an additional 90 minutes with vigorous shaking. Aliquots from each well are dispensed onto the upper ¼ of a 15×100 mm blood agar plate. The blood agar plate is tilted while pipetting to allow the liquid suspension to "run" down the plate. Plates are incubated overnight in 5% $CO_2$ at 37° C. The viable cfu are counted the following morning. Negative control wells, lacking bacterial cells, test serum, complement and/or phagocytes in appropriate combination are included in each assay. A test serum control, which contains test serum plus bacterial cells and heat inactivated complement, is included for each individual serum. This control can be used to assess whether the presence of antibiotics or other serum components are capable of killing the bacterial strain directly (i.e. in the absence of complement or PMN's). A human serum with known opsonic titer is used as a positive human serum control. The opsonic antibody titer for each unknown serum is calculated as the reciprocal of the initial dilution of serum giving 50% cfu reduction compared to the control without serum.

Example 6

Intranasal or Parenteral Immunization of CBA/CaHN Mice Prior to Challenge

Six-week old, pathogen-free, male CBA/CaHN xid/j (CBA/N) mice are purchased from Jackson Laboratories (Bar Harbor, Me.) and housed in cages under standard temperature, humidity, and lighting conditions. CBA/N mice, at 10 animals per group, are immunized with an appropriate amount of the protein(s) to be tested. For parenteral immunization, the protein is mixed with 100 µg of MPL™ per dose to a final volume of 200 µl in saline and then injected subcutaneously (SC) into mice. All groups receive a booster with the same dose and by the same route 3 and 5 weeks after the primary immunization. Control mice are injected with MPL™ alone. All mice are bled two weeks after the last boosting; sera is then isolated and stored at −20° C. For intranasal (IN) immunization, mice receive three IN immunizations, one week apart. On each occasion, an appropriate dose of the protein to be tested is formulated with 0.1 µg of CT-E29H, a genetically modified cholera toxin that is reduced in enzymatic activity and toxicity (Tebbey et al., 2000), and slowly instilled into the nostril of each mouse in a 10 µl volume. Mice immunized with CT-E29H alone are used as controls. Serum samples are collected one week after the last immunization.

Example 7

$LD_{50}$ Determination

Six or 12-week old CBA/N mice (10 per group) are challenged intranasally (IN) with 10 µl of a suspension of streptomycin resistant type 3 Streptococcus pneumoniae diluted to $5\times 10^9$ CFU/ml in PBS. Two-fold serial dilutions of this suspension are also tested. The actual doses of bacteria administered are determined by plating dilutions of the inoculum on streptomycin containing tryptic soy agar plates. The $LD_{50}$ is calculated by the Reed-Muench method as discussed by Lennette (Lennette, 1995). The $LD_{50}$ of 13-week old CBA/N mice with type 3 strain was previously shown to be $1\times 10^5$ CFU, while the $LD_{50}$ of 6-week old CBA/N mice was $1\times 10^4$ CFU.

Example 8

CBA/CaHN XID Mouse Intranasal Challenge Model

Mice are challenged with either serotype 3 or serotype 14 streptomycin resistant Streptococcus pneumoniae. Pneumococci are inoculated into 3 ml of Todd-Hewitt broth containing 100 µg/ml of streptomycin. The culture is grown at 37° C. until mid-log phase, then diluted to the desired concentration with Todd-Hewitt broth and stored on ice until use. Each mouse is anesthetized with 1.2 mg of ketamine HCl (Fort Dodge Laboratory, Ft. Dodge, Iowa) by intraperitoneal (IP) injection. The bacterial suspension is inoculated to the nostril of anesthetized mice (10 µl per mouse). The actual dose of bacteria administered is confirmed by plate count. Two or 3 days after challenge, mice are sacrificed, the noses are removed, and homogenized in 3-ml sterile saline with a tissue homogenizer (Ultra-Turax T25, Janke & Kunkel Ika-Labortechnik, Staufen, Germany). The homogenate is 10-fold serially diluted in saline and plated on streptomycin containing TSA plates. Fifty µl of blood collected 2 days post-challenge from each mouse are also plated on the same kind of plates. Plates are incubated overnight at 37° C. and then colonies are counted. CBA/N mice are observed daily after challenge, and the mortality is monitored for 14 days.

Example 9

Intranasal Immunization of BALB/C Mice Prior to Challenge

Six-week old, pathogen-free, Balb/c mice are purchased from Jackson Laboratories (Bar Harbor, Me.) and housed in cages under standard temperature, humidity, and lighting conditions. BALB/C mice, at 10 animals per group, are immunized with an appropriate amount of the protein to be tested on weeks 0, 2, and 4. On each occasion, the protein being tested is formulated with 0.1 µg of CT-E29H, and slowly instilled into the nostril of each mouse in a 10 µl volume. Mice immunized with Keyhole Limpet Hemocyanin (KLH)-CT-E29H are used as controls. Serum samples are collected 4 days after the last immunization.

Example 10

Mouse Intranasal Challenge Model

Balb/c mice are challenged on the sixth day of week 4 (i.e., at approximately 27 days) with 1×10⁵ CFU's of serotype 3 streptomycin resistant *Streptococcus pneumoniae*. Pneumococci are inoculated into 3 ml of Todd-Hewitt broth containing 100 µg/ml of streptomycin. The culture is grown at 37° C. until mid-log phase, then diluted to the desired concentration with Todd-Hewitt broth and stored on ice until use. Each mouse is anesthetized with 1.2 mg of ketamine HCl (Fort Dodge Laboratory, Ft. Dodge, Iowa) by i.p. injection. The bacterial suspension is inoculated into the nostril of anesthetized mice (10 µl per mouse). The actual dose of bacteria administered is confirmed by plate count. Four days after challenge, mice are sacrificed, the noses removed, and homogenized in 3-ml sterile saline with a tissue homogenizer (Ultra-Turax T25, Janke & Kunkel Ika-Labortechnik, Staufen, Germany). The homogenate is 10-fold serially diluted in saline and plated on streptomycin containing TSA plates. Fifty µl of blood collected 2 days post-challenge from each mouse also is plated on the same kind of plates. Plates are incubated overnight at 37° C. and then colonies are counted.

REFERENCES

International Application No. EP A02323621
International Application No. EP 0036776
International Application No. EP 0859055
International Application No. EP 125,023
International Application No. EP 171,496
International Application No. EP 171,496
International Application No. EP 184,187
International Application No. EP 264166
International Application No. PCT/US86/02269
U.S. Pat. No. 4,196,265
U.S. Pat. No. 4,522,811
U.S. Pat. No. 4,554,101
U.S. Pat. No. 4,683,195
U.S. Pat. No. 4,683,202
U.S. Pat. No. 4,736,866
U.S. Pat. No. 4,816,567
U.S. Pat. No. 4,870,009
U.S. Pat. No. 4,873,191
U.S. Pat. No. 4,873,316
U.S. Pat. No. 4,987,071
U.S. Pat. No. 5,116,742
U.S. Pat. No. 5,223,409
U.S. Pat. No. 5,272,057
U.S. Pat. No. 5,283,317
U.S. Pat. No. 5,328,470
U.S. Pat. No. 5,498,531
U.S. Pat. No. 5,766,844
U.S. Pat. No. 5,789,654
U.S. Pat. No. 5,798,209
U.S. Pat. No. 6,201,103
U.S. SIR No. H1,892
International Application No. WO 86/01533
International Application No. WO 90/02809
International Application No. WO 90/11354
International Application No. WO 91/01140
International Application No. WO 91/17271
International Application No. WO 92/01047
International Application No. WO 92/0968
International Application No. WO 92/09690
International Application No. WO 92115679
International Application No. WO 92/18619
International Application No. WO 92120791
International Application No. WO 93/01288
International Application No. WO 93/04169
International Application No. W094/10300
International Application No. WO 94/16101
International Application No. WO 97/07668
International Application No. WO 97/07669
International Application No. WO 00/63364
Abravaya et al., *Nucleic Acids Res.*, 23:675-682, 1995.
Adams et al, *Nature* 355:632-634, 1992.
Adams et al., *Nature* 377 Supp:3-174, 1995.
Adams et al., *Science* 252:1651-1656, 1991.
Altschul et al, "Gapped BLAST and PSI-BLAST: a new generation of protein database search programs," *Nuc. Acids Res.* 25(17):3389-402, 1997.
Altschul et al., *J. Molec. Biol.* 215:403-410, 1990.
Amann et al., *Gene* 69:301-315, 1988.
Anderson, "*Techniques for the preservation of three-dimensional structure in preparing specimens for the electron microscope.*" Trans. N. Y. Acad. Sci. 13(130):130-134, 1951.
Bairoch and Apweiler, *Nucleic Acids Research*, 28:45-48, 2000.
Baldari et al., *Embo J.* 6:229-234, 1987.
Banerji et al., *Cell*, 33:729-740; 1983.
Barker et al., *Nucleic Acids Research*, 29:29-32,2001.
Bartel and Szostak, *Science* 261:1411-1418, 1993.
Bartel et al. *Biotechniques* 14:920-924, 1993(b).
Bartel, "Cellular Interactions and Development: A Practical Approach", pp. 153-179, 1993(a).
Bateman et al., "The Pfam protein families database, "*Nucleic Acid Res.*, 28(1), 263-266, 2000.
Benson, "Tandem repeats finder: a program to analyze DNA sequences," *Nucleic Acids Res.* 27(2):573-80, 1999.
Bradley, *Current Opinion in Biotechnology* 2:823-829, 1991.
Bradley, in "Teratocarcinomas and Embryonic Stem Cells: A Practical Approach," E. J. Robertson, ed., IRL, Oxford, pp. 113-152, 1987.
Briles et al., "Intranasal immunization of mice with a mixture of the pneumococcal proteins PsaA and PspA is highly protective against nasopharyngeal carriage of *Streptococcus pneumoniae*," *Infect. Immun.* 68(2):796-800, 2000.
Bunzow et al, *Nature*, 336:783-787, 1988.
Burge and Karlin, "Prediction of complete gene structures in human genomic DNA." *J. Mol. Biol.* 268:78-94, 1997.
Butler et al., "Pneumococcal vaccines: history, current status, and future directions," *Am. J. Med.* 107(IA):69S-76S, 1999.
Byrne and Ruddle, *PNAS* 86:5473-5477, 1989.
Calame and Eaton, *Adv. Immunol.* 43:235-275, 1988.
Campes and Tilghman, *Genes Dev.* 3:537-546, 1989.
Chen et al., *PNAS* 91:3054-3057, 1994.
Cohen et al., Adv. Chromatogr. 36:127-162, 1996.
Cotton et al., PNAS 85:4397, 1988.
Cotton, *Mutat Res.* 285:125-144, 1993.
Cowan et al., "RGS Proteins: Lessons from the RGS9 subfamily," *Progress in Nucleic Acid Research and Molecular Biology* 65:341-359, 2001.
Crain et al., "*Streptococcus pneumoniaecoccal* surface protein A (PspA) is serologically highly variable and is expressed by all clinically important capsular serotypes of *Streptococcus pneumoniae,"Infect. Immun.* 58(10):3293-9, 1990.

Cserzo et al., "Prediction of transmembrane alpha-helices in prokaryotic membrane proteins: the dense alignment surface method," *Protein Engineering* 10(6):673-6, 1997.

D'Eustachio et al., *Science* 220:919-924, 1983.

Devereux et al., *Nucleic Acids Research* 12(1):387, 1984.

Dintilhac, et al., "Competence and virulence of *Streptococcus pneumoniae*: Adc and PsaA mutants exhibit a requirement for Zn and Mn resulting from inactivation of putative ABC metal permeases," *Mol. Microbiol.* 25(4):727-739, 1997.

Doestschman et al., *J. Embryol. Exp. Morphol.* 87:27-45, 1985.

Douglas et al., "Antibody response to pneumococcal vaccination in children younger than five years of age," *J. Infect. Dis.* 148:131-137, 1983.

Eddy, "Hidden Markov models" *Current Opinion in Structural Biology* 6(3):361-5, 1996.

Edlund et al., *Science* 230:912-916, 1985.

Eichelbaum, *Clin. Exp. Pharmacol Physiol*, 23(10-11):983-985, 1996.

Elledge et al., *Proc. Natl. Acad. Sci. USA*, 88:1731-1735, 1991.

Eng, McCormack and Yates, "An approach to correlate tandem mass-spectral data of peptides with amino-acid-sequences in a protein database," *Journal of the American Society for Mass Spectrometry,"* 5:976-989, 1994.

Fan, Y. et al., *PNAS*, 87:6223-27, 1990.

Finely et al., *Proc. Natl. Acad. Sci. USA*, 91:12980-12984, 1994.

Foster and Hook, "Surface protein adhesins of *Staphylococcus aureus,"* *Trends Microbiol.* 6(12):484-8, 1998.

Fraser et al., "Genomic sequence of a Lyme disease spirochaete, *Borrelia burgdorferi" Nature* 390(6660):580-6, 1997.

Frohman et al., *Proc. Natl. Acad. Sci. USA* 85, 8998-9002, 1988.

Gaultier et al., *Nucleic Acids Res.* 15:6625-641, 1987.

Gentz et al., *Proc. Natl. Acad. Sci. USA*, 86:821-824, 1989.

Goldstein and Garau, "30 years of penicillin-resistant *S pneumoniae*: myth or reality?," *Lancet* 350(9073):233-4.

Gray, *Conjugate Vaccines Supplement p* 694-697, 1990.

Griffin et al., *Appl. Biochem. Biotechnol.* 38:147-159, 1993.

Gunnar von Heijne, "Membrane Protein Structure Prediction, Hydrophobicity Analysis and the Positive-inside Rule" *J. Mol. Biol.,* 225:487494, 1992.

Harlow and Lane, "Antibodies: A Laboratory Manual," Cold Spring Harbor Laboratory Press, Cold Spring Harbor, N.Y., 1988

Harper et al., *Cell,* 75:805-816, 1993.

Haselhoff and Gerlach, *Nature* 334:585-591, 1988.

Hausdorff et al., "Which pneumococcal serogroups cause the most invasive disease: implications for conjugate vaccine formulation and use, part I," *Clinical Infectious Diseases* 30(1):100-21, 1997.

Hayashi, *Genet Anal. Tech. Appl.* 9:73-79, 1992.

Helene et al., *Ann. N. Y Acad Sci.* 660:27-36, 1992.

Helene, *Anticancer Drug Des.* 6(6):569-84, 1991.

Hepler, "Emerging roles for RGS proteins in cell signalling," *Trends in Phamacological Sciences* 20:376-382, 1999.

Hernandez-Sanchez et al., "lambda bar minigene-mediated inhibition of protein synthesis involves accumulation of peptidyl-tRNA and starvation for tRNA," *EMBO Jour.* 17(13):3758-65,1998.

Hogan, "Manipulating the Mouse Embryo," Cold Spring Harbor Laboratory Press, Cold Spring Harbor, N.Y., 1986.

Inoue et al, *FEBS Left.* 215:327-330, 1987(a).

Inoue et al., *Nucleic Acids Res.* 15:6131-6148, 1987(b).

Isberg and Tran Van Nhieu, "Binding and internalization of microorganisms by integrin receptors," *Trends in Microbiol.* 2(1):10-4, 1994.

Iwabuchi et al., *Oncogene* 8:1693-1696, 1993.

Johnson et al., *Endoc. Rev.,* 10:317-331, 1989.

Kaufman et al., *EMBO J* 6:187-195, 1987.

Kessel and Gruss, *Science* 249:374-379, 1990.

Klein et al., *Curr. Genet.*, 16:145-152, 1989(b).

Klein et al., *Curr. Genet.*13:29-35, 1989(a).

Koebnik, "Proposal for a peptidoglycan-associating alpha-helical motif in the C-terminal regions of some bacterial cell-surface proteins," *Mol. Microbiol.* 16(6):1269-70, 1995.

Krappa et al., "Evectins: Vesicular proteins that carry a pleckstrin homology domain and localize to post-Golgi membranes," *Proceedings of the National Academy of Sciences* 96:46334368, 1999.

Kurj an and Herskowitz, *Cell* 933-943, 1982.

Kyte and Doolittle, *J. Mol. Biol.,* 157:105-132, 1982.

Lakso et al., *PJVAS* 89:6232-6236, 1992.

Laemmli, "Cleavage of structural proteins during the assembly of the head of bacteriophage T4," *Nature* (London) 227:680-685, 1970.

Lefkowitz, *Nature,* 351:353-354, 1991.

Lennette, "General principles for laboratory diagnosis of viral, rickettsial, and chlamydial infections," p. 17-18, diagnostic procedures for viral, rickettsial, and chlamydial infections, vol. 7th edition, 1995.

Lewis, "Programmed death in bacteria," Microbiol. Mol. Biol. Rev. 64(3):503-14, 2000.

Li et al., *Cell* 69:915, 1992.

Linder, *Clin. Chem.* 43(2):254-266, 1997.

Loessner et al., "Evidence for a holin-like protein gene fully embedded out of frame in the endolysin gene of Staphylococcus aureus bacteriophage 187," *J. Bacteriol.* 181 (15):4452-60, 1999.

Lowry et al., "Protein measurement with the Folin-Phenol reagents," *J. Biol. Chem.* 193:265-275, 1951.

Lucklow and Summers, *Virology* 170:31-39, 1989.

Lukashin and Borodovsky, "GeneMark.hmm: new solutions for gene finding," *Nuc. Acids Res.* 26(4): 1107-15, 1998.

Madura et al., *J. Biol. Chem.* 268:12046-1205, 1993

Maher, *Bioassays* 14(12):807-15, 1992.

Mansour et al., *Nature* 336:348, 1988

Maxim and Gilbert, PNAS 74:560,1977.

Mazmanian et al., "Staphylococcus aureus sortase, an enzyme that anchors surface proteins to the cell wall," *Science* 285(5428):760-3, 1999.

McAtee et al., "Characterization of a Helicobacter pylori vaccine candidate by proteome techniques," *J. Chromatogr. B. Biomed. Sci Appl.* 714(2):325-33, 1998(c).

McAtee et al., "Identification of potential diagnostic and vaccine candidates of Helicobacter pylon by "proteome" technologies," *Helicobacter* 3(3):163-9, 1998(a).

McAtee et al., "Identification of potential diagnostic and vaccine candidates of Helicobacter pylori by two-dimensional gel electrophoresis, sequence analysis, and serum profiling," *Clin. Diagn. Lab. Immunol* 5(4):537-42, 1998 (b).

McDaniel et al., "Monoclonal antibodies against protease-sensitive pneumococcal antigens can protect mice from fatal infection with *Streptococcus pneumoniae,"J. Exp. Med.* 160(2):386-97, 1984.

Mejlhede et al., "Ribosomal-1 frameshifting during decoding of *Bacillus subtilis* cdd occurs at the sequence CGA AAG," *J. Bacteriol.* 181 (9):2930-7, 1999.

Morrison et al., "Isolation and characterization of three new classes of transformation deficient mutants of *Streptococ-* cus pneumoniae that are defective in DNA transport and genetic recombination," Journal of Bacteriology, 156: 281-290, 1983.

Morin et al., Nucleic Acids Res., 21:2157-2163, 1993.

Myers et al., Nature 313:495, 1985(a).

Myers et al., Science 230:1242, 1985(b).

Nabors et al., "Immunization of healthy adults with a single recombinant pneumococcal surface protein A (PspA) variant stimulates broadly cross-reactive antibodies to heterologous PspA molecules," Vaccine 18:1743-1754, 2000.

Nakai and Kanehisa, "Expert system for predicting protein localization sites in gram-negative bacteria," Proteins 11 (2):95-110, 1991.

Navarre and Schneewind, "Surface Proteins of Gram-Positive Bacteria and Mechanisms of Their Targeting to the Cell Wall Envelope," Microbiol. Mol. Biol. Rev. 63(1): 174-229, 1999.

Nielsen et al., "Identification of prokaryotic and eukaryotic signal peptides and prediction of their cleavage sites," Protein Engineering 10(1): 1-6 ,1997.

O'Gon-nan et al., Science 251:1351-1355, 1991.

Olmsted et al., "High-resolution visualization by field emission scanning electron microscopy of Enterococcus faecalis surface proteins ncoded by the pheromone-inducible conjugative plasmid pCF10," J. Bacteriol. 175(19):6229-37, 1993.

Orita et al., PNAS 86:2766, 1989.

Orihuela et al., "Peritoneal culture alters Streptococcus pneumoniae protein profiles and virulence properties," Infect. Immun. 68:6082-6086, 2000.

Park and Teichmann, "DIVCLUS: an automatic method in the GEANFAMMER package that finds homologous domains in single- and multi-domain proteins," Bioinformatics 14(2):144-50, 1998.

Parkhill et al., "Complete DNA sequence of a serogroup A strain of Neisseria meningitidis Z2491," Nature 404 (6777):502-6, 2000.

Pierschbacher and Ruoslahti, "Influence of stereochemistry of the sequence Arg-Gly-Asp-Xaa on binding specificity in cell adhesion," J. Biol. Chem. 262(36):17294-8, 1987.

Pinkert et a. Genes Dev. 1:268-277, 1987.

Pizza et al., "Identification of vaccine candidates against serogroup B meningococcus by whole-genome sequencing," Science 287(5459):1816-20, 2000.

Pugsley, "The complete general secretory pathway in gram-negative bacteria," Microbiol. Rev. 57(1):50-108, 1993.

Queen and Baltimore, Cell 33:741-748, 1983.

Rahman et al., Journal of Neuroscience 19:2016-2026, 1999.

Rose et al., "Methods in Yeast Genetics: A Laboratory Course Manual." Cold Spring Harbor Press, Cold Spring Harbor, N.Y. (1990).

Rosenow et al., "Contribution of novel choline-binding proteins to adherence, colonization and immunogenicity of Streptococcus pneumoniae," Mol. Microbiol. 25(5): 819-29, 1997.

Ross and Wilkie, "GTPase-activating proteins for Heterotrimeric G proteins: Regulators of G protein Signaling (RGS) and RGS-like proteins," Annual Reiew of Biochemistry 69:795-827, 2000.

Saleeba et al., Meth. Enzymol. 217:286-295, 1992.

Salzberg et al, "Microbial gene identification using interpolated Markov models," Nuc. Acids Res. 26(2):5448, 1998.

Sambrook et al., "Molecular Cloning: A Laboratory Manual" 2nd, ed, Cold Spring Harbor Laboratory, Cold Spring Harbor Laboratory Press, Cold Spring Harbor, N.Y., 1989.

Sampson et al., "Cloning and nucleotide sequence analysis of psaA, the Streptococcus pneumoniae gene encoding a 37-kilodalton protein homologous to previously reported Streptococcus sp. Adhesins," Infect. Immun. 62(1):319-24, 1994.

Sanger, PNAS 74:5463,1977.

Schultz et al., Gene 54:113-123, 1987.

Seed, Nature 329:840, 1987.

Shinefield and Black, "Efficacy of pneumococcal conjugate vaccines in large scale field trials (In Process Citation)," Pediatr. Infect. Dis. J. 19(4):394-7, 2000.

Simon et al., Science, 252:802-8, 1991.

Smith and Johnson, Gene 67:3140, 1988.

Smith et al., Mol. Cell Biol. 3:2156-2165, 1983.

Songyang, et al., Cell 72:767-778, 1993.

Sonnenberg and Belisle, "Definition of Mycobacterium tuberculosis culture filtrate proteins by two-dimensional polyacrylamide gel electrophoresis, N-terminal amino acid sequencing, and electrospray mass spectrometry," Infect. Immun. 65(11):4515-24, 1997.

Sonnhammer et al., "A hidden Markov model for predicting transmembrane helices in protein sequences," Ismb 6:175-82, 1998.

Stockbauer et al., "A natural variant of the cysteine protease virulence factor of group A streptococcus with an arginine-glycine-aspartic acid (RGD) motif preferentially binds human integrins alphavbeta3 and alphaIIbbeta3 (In Process Citation)," Proc. Natl. Acad. Sci. U S A 96(1): 242-7, 1999.

Studier et al. "Gene Expression Technology" Methods in Enzymology 185, 60-89, 1990.

Talkington et al., "Protection of mice against fatal pneumococcal challenge by immunization with pneumococcal surface adhesin A (PsaA)," Microb. Pathog. 21(1):17-22, 1996.

Tebbey et al., "Effective mucosal immunization against respiratory syncytial virus using a genetically detoxified cholera holotoxin, CT-E29H," Vaccine 18(24):2723-34, 2000.

Thomas and Capecchi, Cell 51:503, 1987.

Weldingh et al., "two-dimensional electrophoresis for analysis of Mycobacterium tuberculosis culture filtrate and purification and characterization of six novel proteins," Infect Immun. 66(8):3492-500, 1998.

Wilmut et al., Nature 385:810-813, 1997.

Wilson et al., Cell 37:767, 1984.

Winoto and Baltimore. EMBO J 8:729-733, 1989.

Xu et al., "PHR1 encodes an abundant, pleckstrin homology domain-containing Integral membrane protein in the photoreceptor outer segments," Journal of Biological Chemistry 274:35676-35685, 1999.

Yamamoto et al., "A nontoxic adjuvant for mucosal immunity to pneumococcal surface protein," A. J. Immunol. 161(8):4115-21, 1998.

Zervos et al., Cell 72:223-232, 1993.

Zhang et al., 2001, "Recombinant PhpA Protein, a Unique Histidine Motif-Containing Protein from Streptococcus pneumoniae, Protects Mice against Intranasal Pneumococcal Challenge," Infect. Immun. 69:3827-3836, 2001.

SEQUENCE LISTING (752 sequences)

SEQ ID NO: 1 - DNA, 684 bp, Streptococcus pneumoniae
gctcgggctaaatcagtccactggactgatttactacaccagtatagcttcaagctctgtcagaaacgattctatcagcccacgtttcgaatgcacttaacccatcgggaagtacgagataagctgctttcttactctgagggattacaggttcactacgaactctatcaactcctgctctttcattttcaagagaagaatgccgaccatttctttggattgattgagcaagaactgccaacggttcatccgctttttcaaacggtcttttggacttttttaagggatagagataagattatcaacgcacttaagctgccttattccaacgctaaacttgaagcgaccaataatttgattaagattatcaagcgcaaagcctttggtttccggaactttaacaattttaaaaaacggattttgatgactttgaacatcaaaaaagagagtacgaatttcgtactctccagattgcagcttttcgcctacccactacacttgacaaagagccactctttattccatggtatcaaaggcaagacttggtttggcattgaggtcccagcctgcgaagttttctttgttccactcgctgacgctggcataggcaatcatacctgcattgtctccgcagagtcgcagaggggggatgataaccttgacatctgtgatttcggctgctag

SEQ ID NO: 2 - DNA, 675 bp, Streptococcus pneumoniae
gagggggcgcaggcagccatgccaacggctcttggctatgtcagtatcggcctggcctgtggaattatcggtgcgccctatgtgacacctgttgagatgggcttgatgagtctctttgtttatgctgggagtgcccagtttgccatgttggcactgattgtggttcaagctcctgtggcagctattgctatgacggtttttctaatcaacttgcgtctctttttgttgagtttacacgcatcgacttatttccgtcataccagtctttggtacaatatcggtatgtctagtatcttgacagatgagacctatggcgttttgatgggtgaattggcccatacagacaaggtaaatcctatgtggatgcacggaaacaatcttaacagctatgtggcttggtttgtggggacagtagtcggaacggctctgggtggcctgctaccaaatccagaaatctttggcttggattttgccctggttgggatgtttattggtatttttgcttcgcaatttcagattatgcaaagacggattcctgtccgcaatctgctcattatcctagcagttgttgcggtgtccttctttttgctcttgacagtgatgtctcagtcactagctgttctgtttgcgacgctacttggttgtagcatgggggtggttttagatggtcagtaa

SEQ ID NO: 3 - DNA, 864 bp, Streptococcus pneumoniae
gattataaggtattctattttggaggaaatgacatgaaaaaaatcgttaaatactcatctcttgcagcccttgctcttgttgctgcaggtgtgcttgcggcttgctcagggggtgctaagaaagaaggagaagcagctagcaagaaagaaatcatcgttgcaaccaatggatcaccaaagccatttatctatgaagaaaatggcgaattgactggttacgagattgaagtcgttcgcgctatctttaaagattctgacaaatatgatgtcaagtttgaaaagacagaatggtcaggtgtctttgctggtcttgacgctgatcgttacaatatggctgtcaacaatcttagctacactaaagaacgtgcggagaaatacctctatgccgcaccaattgcccaaaatcctaatgtccttgtcgtgaagaaagatgactctagtatcaagtctctcgatgatatcggtggaaaatcgacggaagtcgttcaagccactacatcagctaagcagttagaagcatacaatgctgaacacacggacaacccaactatccttaactatactaaggcagacttgcaacaaatcatggtacgtttgagcgatggacaatttgactataagatttttgataaaatcggtgttgaaacagtgatcaagaaccaaggtttggacaacttgaaagttatcgaacttccaagcgaccaacaaccgtacgtttacccacttcttgctcagggtcaagatgagttgaaatcgtttgtagacaaacgcatcaaagaactttataaagatggaactcttgaaaaattgtctaaacaattcttcggagacacttatctaccggcagaagctgatattaaataa

SEQ ID NO: 4 - DNA, 1389 bp, Streptococcus pneumoniae
aaaggtagagagaatatggtttttcctagcgaacaagaacagattgaaaaatttgaaaaggatcatgtagcccagcattattttgaggttttgcgtaccttgatttctaagaaatcagtctttgcccagcaggttggactcaaggaagtcgcaaattatctgggtgagattttcaagcgtgttggagctgaagtggagattgatgagagctatacagcgccctttgtcatggcacatttcaagagttcgcgtccagatgccaagaccttgattttctataaccactatgacactgtgccagcggatggggatcaggtctggacagaggatccttttacgctttcggtccgcaatggcttcatgtatgggcgtggggttgatgacgacaagggtcatatcacagctcgcttgagtgctttgagaaaatatatgcagcaccatgatgatttacctgtcaatatcagctttatcatggagggagcggaggaatcggcttcaacagacctagataagtatttggaaaagcatgcagacaaactccgtggggcggatttgttggtctgggaacaagggaccaaaaatgccttggaacagctggaaatttctggtggcaataaggggattgtgacctttgatgccaaggtaaaaagcgctgatgtggatatccactcgagttatggtggtgttgtggaatcagctccttggtatctcctccaagccttacagtctcttcgtgctgcggatggccgtatcttggttgaaggcttgtacgaagaagtacaagagcccaatgaacgagaaatggccttgctagaaacttatggtcaacgaaacccagaggaagttagtcggatttatggattggagttgcctctcttacaggaggagcggatggcctttctaaaacgtttctttttcgatccagcgcttaatatcgaaggaatccagtctggttatcaaggtcagggtgttaagactattttacctgcagaagccagtgccaagctagaggttcgtctggttccgggcctagaaccgcatgatgttctggaaaaaattcggaaacagctagacaaaaatggctttgataaggtagaattatactataccttgggagagatgagctatcgaagcgatatgagcgcaccagccattctcaatgtgatcgagttggccaagaaattctatccacagggcgtttcagtcttgccgacgacagcggggacaggacctatgcatacggtctttgatgccctagaggtaccaatggttgcattcggtctaggaaatgccaatagccgagaccacggtggagatgaaaatgtgcgaatcgctgattattacacccatatcgaattagtagaggagctgattagaagctatgagtag

SEQ ID NO: 5 - DNA, 624 bp, Streptococcus pneumoniae
gggaatatcatgggtagatttttagactttgtctttaatcgtttctttttagggatgattgcgacagccttcttttggctattaactttagcaggagggattatccttggtctagcgccggctagtgccaccttgatgagcttatatgcagaacatggttatagctttcgggaatacagtttgaaggaggcttggtctctttacaagcaaaattttgtctcaagcaacctgattttctatagctttttaggtgtgggtctagttttgacctatggtttgtatctcttggtgcaattgcctcatcagaccattgttcatttgattgcgacccttttgaatgtcctagtagttgccctgatctttttggcttatacagtatctttaaaattacaagtttattttgccttgtcctatcgaaatagtctcaaattatccttgattggcatctttatgagtctagcagctgtggctaaggttctccttgggactgtgctacttgtagcaattggttattatatgcctgccctgctattttttgtaggaattgggatgtggcatttctttatcagtgatatgttggaacctgtctatgaaatcatccatgaaaaattggcgacaaaatag

SEQ ID NO: 6 - DNA, 630 bp, Streptococcus pneumoniae
actcttgccaaccaattttatccaaatttcccaatcagaaatcatcaatatcgattccatctctcacctcaagctcacgccaaacggtctggtagaaattttcttgaaaaacgaaagcttcacctactcttcacgccgttatctaaaaaccatcaaggagaaattagaactatgaaaaaacaagtatttcacgatgcagctaccggtgttcttatcggcctcatcctctctatcctcttttcactcatttatgcaccaaatacctacgcaccactaaatccctactctctcataggccaagtgatggatcagcatcaggttcacggtgccctggtcttgctctactgcacacttatctgggcaaccatcggtatgctcttcaactttggcaaccgcttatttagccgtgactggagcatgcttcgtgccactctgactcatttcttccttatgctggctggctttgtcccactagcaactcttgctggttggttccctttccactggattttctacctccagctcattatcgagtttgcgattgtctatctcatcatctgggctattctctataaaagagaggctaaaaaagtagatcacatcaatcaactcttggagcatagaaaatag

SEQ ID NO: 7 - DNA, 609 bp, Streptococcus pneumoniae
gagagaaggaatactatgtacgcatatttaaaaggaatcattaccaaaattactgccaaatacattgttcttgaaaccaatggtattggttatatcctgcatgtggccaatccttatgcctattcaggtcaggttaatcaggaggctcagatttatgtgcatcaggttgtgcgtgaggacgcccatttgctttatggatttcgctcagaggatgagaaaaagctctttcttagtctgatttcggtctctgggattggtcctgtatcagctcttgctattatcgctgctgatgacaatgctggcttggttcaagccattgaaaccaagaacatcacctacttgaccaagttccctaaaattggcaagaaaacagcccagcagatggtgctggacttggaaggcaaggtagtagttgcaggagatgaccttcctgccaaggtcgcagtgcaagcaagtgctgaaaaccaagaattggaagaagctatggaagccatgttggctctgggctacaaggcaacagagctcaagaaaatcaagaaattctttgaaggaacgacagatacagctgagaactatatcaagtcggcccttaaaatgttggtcaaatag

SEQ ID NO: 8 - DNA, 675 bp, Streptococcus pneumoniae
tgtagaaaatgcagaagcacgtttgcgtgcagctctataaacatcaaggctgggagcacttcccagtcttattctattttaatttcaaaaagaaagaagaaagaaatgaaaaaaatagttcttgttagtctagctttcctttttgtcctggttggttgcggacagaaaaaagaaactggaccagctacaaaaacagaaaaagatacgcttcagtcggcattgccagttattgaaaatgctgagaagaatacagttgtaactaagactttggtcttgcccaagtcagatgatggtagccagcagacacaaacaattacttacaaagacaagacttttttgagtctagctatccaacaaaaacgtccagtctctgatgagttgaagacttatattgaccaacatggagtggaggaaactcaaaaagctcttcttgaagcggaggagaaggataagtctatcattgaagctcgtaaattggcaggtttcaaacttgaaacaaaactattgagcgcaacggaacttcaaacaacgactagttttgattttcaagttctggatgtcaagaaggcttcccagttggaacatctgaagaatattggtttggaaaatcttttgaaaaatgaaccaagcaaatatatttcagatagattggcaaatggcgcgacagaacaatag

SEQ ID NO: 9 - DNA, 555 bp, Streptococcus pneumoniae
gcagataaattgactccattttttgaacttgttatactaggggaattgctggttagagaaaatttctctaaattggtagcagaaaggaaattcatcatgaaattaaaaagattcacactttctcttgcttctctagcaagttttagtctcttagtagcttgttcacaaagagctcaacaggttcaacagcctgttgctcagcagcaggtccaacaacctgctcaacagaataccaatactgcaaatgcaggaggtaaccaaaatcaagcggctccagtacaaaaccaacctgttgctcaaccgaccgatattgatgggacttatactggtcaggatgacggagaccgtatcactttagtggtaactggaacgactggtacatggactgagctcgaatctgacggggatcagaaagtcaaacaggttacattggattcagcaaatcaacgcatgattattggcgatgatgtcaaaatttacactgtaaacggtaatcaaatcgtcgtagatgatatggatagagacccatcggaccaaatcgttttaactaaataa

SEQ ID NO: 10 - DNA, 1557 bp, Streptococcus pneumoniae
cattcaaactatcaaggaggggatatgaaatataggaaatttcaattattgatgtccaagtatggctttagtctttcgattatgctacttgaactttgtcttgtttttggtctctttctttatttaggacgcatggctcccattttatggattactgtcctcattctactgagtatcatcacaatcatttcgatagtcaaccgtaatacgactcctgagaataaggtaacctggttgttagtagcctttgtgccagtatttggtcccttgctctatctgatgtttggtgaaaggcgattgtccaaaaaagaaatcaaacaactgaagaagctaggctctatgcatttccaagaagcaaatagccagctactaaaagagaaattaaaagaaagtgacaaggcagcttatggagtcatcaagtccttattgagtatggataccaatgctgacatctatgatcaaactgcctctacattttttcctaacggagaagctatgtggaaaaagatggtagaagatcttaaaaaggctgagaaatttattttcttggaatattacattatagaagaaggtttgatgtggaatcgcatactagatatactagagcaaaaggtagctcagggtgtagaggttaagatgctctatgatgatatcggctgtatggctactttaacaggagattatgcacatcgacttcgtcagctgggcatcgaggcccataaattcaataaagttattcctcgtttgacagtggcttataataacagagatcatagaaaaatattgattgttgatggtcagatagcctatactggtggggtcaatctggcagatgagtacattaaccacgtcgagagatttggttattggaaggatagtggaattcgcttagacggactagcagtaaaagctctgacacgcttatttttgaccacttggtacattaatcgaggagaaattagtgattttgatcaatatcatttagaaaatcattctatcccgagtgacggtttaaccattccatacggaagtggacccaagccaatttttcgagcgcaggtagggaaaaaagtttatcagagtttaatcaatcaagcaacagaatcggtctatattacgacaccttatttgattatagattatgatttaacagagacaatcaaaaatgcagctatgagaggggtcgatgttcgaattatcaccccttacataccagataagaagttcattcagttagtcacgagaggagcttatcccgaccttctttctgctggtgttcggatttatgagtatagtccaggttttattcatagtaagcagatgttggtagacgaagattttgcggtggtggggacaatcaatctcgactaccggagcttggtacaccattatgaaaatgcagtcttactctataaaactccttctataagggaaatcgcccgagattttcgaaatatatttgcagattctcaggaagtctatcctcattctatcaaaacgagctggtatcaaaagcttgtaaaagaaatcgcccagctattcgcccctatcttataa

SEQ ID NO: 11 - DNA, 282 bp, Streptococcus pneumoniae
gaagacatcattgatatcttgattaccttcgatgtcatgaaccaaacctttggcacggtagtgagcaatgattggttctccttgagcaatattaacatccaaacgacgttttactgtctcaggcttatcatcttcacgttggtagtaatcttcttctttatagtcaactggtgggttaaagaccttgtggaaagtttctccagttacgcggtggatgatacgcccactcaaacgttccaaaaggctgtcagggttcacttcaatattgataacaccttctag

SEQ ID NO: 12 - DNA, 1473 bp, Streptococcus pneumoniae
atgataaatgatataattctattattgttcgtaaaaattaaaaggagattgatgatggacaaattatttaaactaaaagagaacggtacagacgttcgtacagaggttctcgctggtttaacaactttctttgcaatgagctatattctctttgtaaacccacaaatactttcacaaacaggaatgcctgctcagggcgtcttcctagcgacgattattggtgcagtagcgggtaccttgatgatggctttttatgctaacttaccttatgcccaagcgccaggtatgggactcaatgccttctttacctttacagttgtattcgggcttggttattcttggcaagaagccctagctatggtcttcatctgtgggattatttcattgattattaccttgacaaatgttcgtaaaatgatcattgaatcgattcccaatgctcttcgctcagctatttcagctggtatcggtgtcttccttgcctatgtagggattaagaatgctggacttttgaaattcacgattgatccaggcaactatactgttgtaggagaaggggctgacaaagctcaagcaacgattgcagcaaactcttcagcagttccaggattggtcagctttaataatccagctgttttagtggctcttgcaggacttgccattactatcttctttgtcatcaaagggattaaagggggaattattctctctatcttgacaacaactgttcttgctattgcagttggtttggttgatttgtctagtatcgattttgctaataaccatgttggtgcagcttttgaagatttgaagacaatctttggtgcagctcttggttcagaaggattgggagctttggtttcagatacagctcgcttgcctgaaactctgatggccattcttgccttctcattgacagatatttttgacacaattggtaccttgatcggtacaggtgaaaaagttggtatcgtagcgacaaatggtgaaaatcaccaatcagccaaattggataaggctctttactctgatttgattggaacgacagtcggtgccattgcaggtacttcaaacgtaacgacttatgttgagtctgctgctggtatcggtgcaggtggacgtactggtttgacagccttggttgtagctatctgttttgcgatttcaagcttctttagcccacttctagcgatcgtaccaacagcggctacagctccaatcttgattatcgttgggattatgatgcttggtagcttgaaaaatatccattgggatgatatgtctgaagcagttcctgccttcttcacatctatctttatgggattcagctactctatcactcaagggattgcagttggtttcttgacttacactttgactaagcttgttaaaggtcaagttaaagatgttcatgtcatgatttggattttggatgccttgtttatccttaactacatcagcatggccttataa

SEQ ID NO: 13 - DNA, 3240 bp, Streptococcus pneumoniae
ttcctattgattttacaatatgtttattggagtgtatacatgcaaacaaaaacaaagaagctcattgtgagtttgtcttcacttgttttatcaggatttttattaaaccattatatgacaattggagcggaagaaacgactacgaataccattcagcaaagccagaaggaagttcagtatcagcaaagggatacaaaaaatttagttgaaaatggtgattttggtcagacggaggacggaagcagtccgtggacaggaagcaaagctcaggggtggtcagcttgggtagaccagaagaatagtgcagatgcctcaactcgagtcattgaggctaaggatggggctatcactatctcaagccatgagaaattaagggcagcgcttcaccgtatggttcctattgaagctaagaaaaagtataaactgcgtttcaagattaaaacagataataaaatcgggattgccaaagttcgtatcattgaggaaagtggtaaggacaagcgattgtggaattctgcaacgacgtcaggaacaaaggactggcagaccattgaagcagactatagcccgactttagatgttgataaaatcaagctggagttattctatgaaacaggaactgggactgtttcctttaaggatattgagctggtagaggtagcagaccagctttctgaggattctcaaacagataaacagcttgaggaaaagattgatttaccaattggaaaaaaacatgttttttctcttgcggactatacttataaggtagaaaatcctgacgttgcttcagtcaaaaatggaattttagaacctcttaaggaagggacaaccaatgtcattgtcagtaaagatggcaaggaagtgaaaaagattcctttgaagattctggcctctgttaaggatgcatacacagaccgtttggatgactggaatggcatcatcgctgggaatcaatactatgattctaaaaatgaacagatggccaaattaaaccaggaattggaaggaaaggtagctgatagcctatccagtatttcaagtcaggcggaccgcacctatttgtgggaaaaattttcaaattataaaacgtctgcaaatctgactgccacttatcggaaattggaggagatggccaagcaagtgaccaatccttcttctcgttattatcaagatgaaactgtcgttcgaacagtcagggattccatggaatggatgcataaacatgtctacaatagtgaaaagagcattgttgggaactggtgggattatgaaatcggtacacctcgtgccatcaacaataccttgtctctgatgaaagaatacttctctgatgaggaaattaaaaaatatacagatgtgattgaaaaatttgtaccagatcccgaacatttccgaaagacgactgataacccattcaaggctctaggtggaaacttagttgatatgggaagggtaaaagtaatagctggtttactgcgtaaggatgatcaagaaatttcttctaccattcgctcgattgagcaagtgttcaagttggtagaccaaggtgaaggtttttatcaagatggatcctatatcgaccacaccaatgttgcctatacgggtgcttatgggaatgttttgattgatggcctgtctcaactgttgccagtcattcaaaagaccaagaatccaatcgataaagataaaatgcaaaccatgtaccactggattgataaatcgtttgctcctttgctggtgaatggagagttgatggatatgagtcgtggacgctcgatcagtcgtgcaaatagcgaggggcacgtggccgcagtagaagtactaagagggattcaccgaatagcggatatgtctgaaggagaaaccaaacaatgtttgcagagtcttgtgaagaccattgttcaatcggatagttattatgatgtctttaagaatttgaagacttataaggatatcagtttgatgcaatccttgttaagtgatgcaggagtcgcaagtgttccaagaccaagttacctatctgcctttaacaagatggataaaacagccatgtacaatgcagagaaagggtttggatttggcttgtcactcttttccagtcgtaccttgaattacgaacacatgaacaaggaaaataaacgtggttggtatacgagtgatgggatgttctatctttacaatggcgatttgagtcactatagcgatggctactggccaacagttaatccatataagatgcctggtacaacagagacggatgctaagagagcggatagcgatacaggtaaagttttaccgtctgctttcgttggaacgagcaaactagatgatgccaatgcgacagcaaccatggatttcaccaactggaatcaaacattgactgctcataagagctggtttatgctaaaggataagatcgcctttttaggaagcaatatccaaaacacttcaacagatactgctgcaactacaattgaccagagaaaactggaatcaggtaatccatataaagtctatgtcaatgataaagaagcctcccttacagaacaagaaaaggattatcctgaaacccaaagtgtctttttagaatcgttcgattcgaaaaagaatattggttactttttctttaagaagagttcaatcagtatgagtaaggctttgcaaaagggagcctggaaggatatcaatgaaggacagtcagacaaggaagttgaaaatgaatttcttacgattagtcaggctcataagcaaaatagagattcttatggctatatgctcattcctaacgtggatcgtgccaccttcaatcaaatgataaaagagttagaaagtagcctcatcgaaaataacgaaacccttcagtctgtttatgatgctaaacaaggagtttggggcattgtgaaatatgatgattctgtctctactatttccaaccaattccaagttttgaaacgtggagtctataccattcgaaaagaaggggatgaatataagattgcctactataatcctgaaacccaggaatcagctccagatcaggaagtctttaaaaagctagagcaagcagctcagccacaagtacagaattcaaaagaaaaggaaaaatctgaagaggaaaagaaccattcggatcaaaagaatctccctcagacaggagaaggtcagtcaatcttggcaagtctagggttcttgctacttggggcattttatctattccgtagaggaaagaacaactaa

SEQ ID NO: 14 - DNA, 831 bp, Streptococcus pneumoniae
tggagctgttcaagtcaacattatggactatatttaaaagaggagatcgttatgtcgattaatgtatttcaagcgattttaattggattatggacagctttctgttttagtggaatgctgttaggaatttacaccaatagatgtattgttctgtcatttggtgtcggaattattctaggtgatctgcctactgctcttgcaatgggagctattggtgaattggcttatatgggattcggtgttggtgctggaggtactgttccaccaaacccaatcggacctggtatctttggtaccttgatggctatcactagtgctggtaaagtcagtccagaagcggctcttgccctctctactccgattgctgtggcgattcaattcttacaaactttcgcctacactgtacgtgctggtgcgcctgaaacagctatgaagcacttgaaaaaccataatttgaagaaatttaagttcactctaaatgcaacaatttggttgtttgcctttattggatttaccttgggttgcttgggtgccctttcaatggataccttgttgaaactcgtagactacattccaccggtattacttacaggtttgacagttgctggtaaaatgctcccagctatcggttttgcgatgatcttgtcagtgatggctaagaaagagttgattccctttgtcttgttgggatatgtttgtgcagcttatctaaacatcccaacaattggtattgcaattgtaggtactatctttgctttgattgaattttataacaagccaaaaacagcggatcatgtggtagaggaggaagcacacgatgactggatctaa

SEQ ID NO: 15 - DNA, 399 bp, Streptococcus pneumoniae
tacatattgtcgactcacttcgtattgcaagagctaaaaaagaccaggattaggaggtgccttatgaaatcactagctagactactgatcattcatgtttttatcagtattttccttttcttcgcccttacttcaggagctatttctcatacagttttactactcctactcctctttcttcctgcgctcaataaaggacttgagaaaatacaatcaaaacggatacctgtcctcaacgcagccctcttctttctcctcatatcctttccacaacttttaaccaaccctgtccaatggaaattttcaatattcctagtcgtaaccatcatttcaagtttggcctacttctataacttttatcaagtagttaaagaagtagatcaaaaacagttgatttag

SEQ ID NO: 16 - DNA, 2256 bp, Streptococcus pneumoniae
gatatgaagtggacaaaaagagtaatccgttatgcgaccaaaaatcggaaatcgccggctgaaaacagacgcagagttggaaaaagtctgagtttattatctgtctttgtttttgccatttttttagtcaattttgcggtcattattgggacaggcactcgctttggaacagatttagcgaaggaagctaagaaggttcatcaaaccacccgtacagttcctgccaaacgtgggactatttatgaccgaaatggagtcccgattgctgaggatgcaacctcctataatgtctatgcggtcattgatgagaactataagtcagcaacgggtaagattctttacgtagaaaaaacacaatttaacaaggttgcagaggtctttcataagtatctggacatggaagaatcctatgtaagagagcaactctcgcaacctaatctcaagcaagtttcctttggagcaaagggaaatgggattacctatgccaatatgatgtctatcaaaaaagaattggaagctgcagaggtcaaggggattgattttacaaccagtcccaatcgtagttacccaaacggacaatttgcttctagttttatcggtctagctcagctccatgaaaatgaagatggaagcaagagcttgctgggaacctctggaatggagagttccttgaacagtattcttgcagggacagacggcattattacctatgaaaaggatcgtctgggtaatattgtacccggaacagaacaagtttcccaacgaacgatggacggtaaggatgtttatacaaccatttccagccccctccagtcctttatggaaacccagatggatgcttttcaagagaaggtaaaaggaaagtacatgacagcgactttggtcagtgctaaaacaggggaaattctggcaacaacgcaacgaccgacctttgatgcagatacaaaagaaggcattacagaggactttgtttggcgtgatatcctttaccaaagtaactatgagccaggttccactatgaaagtgatgatgttggctgctgctattgataataatacctttccaggaggagaagtctttaatagtagtgagttaaaaattgcagatgccacgattcgagattgggacgttaatgaaggattgactggtggcagaacgatgactttttctcaaggttttgcacactcaagtaacgttgggatgaccctccttgagcaaaagatgggagatgctacctggcttgattatcttaatcgttttaaatttggagttccgacccgtttcggtttgacggatgagtatgctggtcagcttcctgcggataatattgtcaacattgcgcaaagctcatttggacaagggatttcagtgacccagacgcaaatgattcgtgcctttacagctattgctaatgacggtgtcatgctggagcctaaatttattagtgccatttatgatccaaatgatcaaactgctcggaaatctcaaaaagaaattgtgggaaatcctgtttctaaagatgcagctagtctaactcggactaacatggttttggtagggacggatccggtttatggaaccatgtataaccacagcacaggcaagccaactgtaactgttcctgggcaaaatgtagccctcaagtctggtacggctcagattgctgacgagaaaaatggtggttatctagtcgggttaaccgactatattttctcggctgtatcgatgagtccggctgaaaatcctgattttatcttgtatgtgacggtccaacaacctgaacattattcaggtattcagttgggagaatttgccaatcctatcttggagcgggcttcagctatgaaagactctctcaatcttcaaacaacagctaaggctttagagcaagtaagtcaacaaagtccttatcctatgcctagtgtcaaggatatttcacctggtgatttagcagaagaattgcgtcgcaatcttgtacaacccatcgttgtgggaacaggaacgaagattaaaaacagttctgctgaagaagggaagaatcttgccccgaaccagcaagtccttatcttatctgataaagcagaggaggttccagatatgtatggttggacaaaggagactgctgagacccttgctaagtggctcaatatagaacttgaatttcaaggttcgggctctactgtgcagaagcaagatgttcgtgctaacacagctatcaaggacattaaaaaaattacattaactttaggagactaa

SEQ ID NO: 17 - DNA, 660 bp, Streptococcus pneumoniae
tttaatttgtcaaatggaaatagaatgaaaaatggaaatagaatttatagttggaggttgtttatgtacggtataataaaacgattaggtgatatattattatctttaatagggataataatattgtgtccggtttttatgataattgcaattgcgattaaacttgattcagaaggtccggttatatttaagcaaaaacgctttggtattcataaagaatacttctatattttgaaatttaggtctatgaaaatagatgcacctaaaaatgtggcgcctcgaaacttatataatccagagcaatggattacaaaagtaggggctttcttgcgaaaaacatctttggatgaactaccacaattgtttaatattcttgttggtaatatgagtattgtaggtcctagaccagcgggtataaatgaactagatttgattgcagagagagataagtatggagcaaatgatatcttgccagggttaactggatgggcacaaattaacgggcgtgatactttgtctgttgagatgaagacggagttagatggctactatgttaaacatctgtctttgataatggatattagatgtatagttaagacaataccttacgtactgaaacgaaaaggtattgtagagggtagtggtaagaaagaaagttaa

SEQ ID NO: 18 - DNA, 1251 bp, Streptococcus pneumoniae
gaaagaaagttaaattggacaatgaaaatactatttgtttgccaacattataagccagaaccattcaggttgtcagatatttgtgaagatttagttcgaaaagggcatgaagtctctgttttggctgggattcctaattaccctgaagggaagatatatgcagattatcgtcataataaaaaaagacgtgagattatagaaggtgttacgatatatcgttcttatacaatccctagaaaaaaaagtgttgtatttcgattgttgaattattttagctttgcaattagttctactttaggagttttattggggaggtataaaacgaaagatggatcgaattttgactgtgtattcgttaaccaattgtctccagttatgatggcatgggctggtatggcttataaaaaaaaatataagaaaccgatgtttctatattgtatggatgtttggccagatagtttaaccgtaggtggagtgaaacaagatggcttgattttcaagctgtttaaatttatctcaaaaaaagtttaccgagctagtgattatatatttgtcactagtccatcatttaaaaattattttgtgaagcaatttgacatatccgaacaaaagattacatatttgccacaatatgcagaagatctttttatccctgatgaatctatagttaataaagaaagtgttgacctaacttttgctggtaatattggcaaagcacaaaatttggaaactattttgaaagctgccagtttgatagagaagaataccaatttacccaagaaaattcattttcattttgttggagatggtacggaattgttaagcatgaaagcattagctcatgaattggagttaaagaatatttccttctatggaagacgttctttggaggaaatgccatccttctataaaaaatcagatgctatgttagtttctttaataggagactcgatagtttctcgtactatacctgggaaggtacaatcttatatggcggcaggcaaaccaattataggtgcaatttcaggagatgctaaaataattgtagaagaagcaaattgtggatatgttagtcccgaacgagatgtaaaacaattggcaaaaaatatttgtaaatttagtatgttatctattaagagacaaagagagttaggaaagaaagctcgttgttactatgaaaatcacttttcaaaagagcagtttatgctcgaactggagacatgtttagagagggaaagtaagaaagaataa

SEQ ID NO: 19 - DNA, 1128 bp, Streptococcus pneumoniae
ggaagaagaatgattaaagtattacatctatttacaacactagatagtggtggagtagaaagttttctattcaactattattctcacattgatagaaaaaaaattcaatttgattttattgtgcctggaaaagaacaaggatttttagaggataaaatgaaagaattgggtgcaaaggtttatcatgtgcctctattaaggaaaaagcctctacatcagtttctctctcttgctagaataataaagaaaggagattatgatatagttcattgccatggctataaatctgcaattggtctgatcttatctaaaataattggttgtaaaattagaattattcatagtcatatggcttatgtaacagaaaacagttttcaaaaagtattgcgtaaattagtaacaattttggtaaaaatcttagcaactcattggtttgcatgtggggaagattcggctaagtggttatatggagagaaagcgtataaagacggaaaaattgaaattatttttaatgcaattgatttgaaaaagtatcaatttttgtcagatgttagagaaaaatgtcgtagagaattagatgtgtcaaataagttcgtattaggaaatatagctcgcctatcagatcaaaaaaaccaaagttatttatttaacgttttaaaagaactcattttaatcaaaccaaatgttattttactcctagttggtaatggtgaggatgagcagaaattaaaacagaaagctttagaactaaatctgaccccatatgtgctatttttagggagaaggactgatatttctgatttattatctgcgatggatgtttttttgcttccgtctaaatatgaggggttgcctgtttctctagtagaggctcaggcatcgggattacaaattttatcgtcagatacagtgacgcaagaagtagatgtgaccaaaaacattagttacttacctatcaacgaagagtctgtgttgctatggaaagataaagtactgtctttaacatctgaggaatgcaatcgttttgaaataaataacagtatgacagatggactctatgatatttgttatcaagctagtaaattattgaatcgttatcaagaaatgtgtgtaataaaggagatatag

SEQ ID NO: 20 - DNA, 1245 bp, Streptococcus pneumoniae
ttcgtgaaagttgatagaatttcatttataaaaaatacaagttctctctatattctgaatattgttaaattactatttcctttattaacactcccgtatttgacaagggtgctttcgctagacgcgtatggaatggttatttatgttaaagcgttaatagcttatgttcaactggtgattgattttggtttcatgatatcagctacaaaaaatattgtaaatgcttgtactactccctcaaagattggaaggatagttggagatactctagttgaaaaaatatttttatctatcatttcgattctaatttacaccatattgatgtggcaaatcccaataatgagagagaatattcttttttcagttttttatttgttagctacagtgaccaatatttttatctttgactttttatttcgtggaattgaaaagatgcatgcagttgcaattccttatattatttctaaaactatcattacaattttgacatttattgtagtaaaagatgattcttctattttatggattcctatattggaaggaattgggaatttagttgctgcagtagtttcttatagattccttcattattatggaattaaattatcattttcttatctgtctgtttgggttaaagatttaaaggaatcctctatttattttttatccaattttgcaactactatttttggcgtctttacgacagtcatttcgggtttttatttacaaagtcaagagatagccttttgggggatagcaatgcaactgctttcagcagcaaaatcattgtataatcctatagcgaatagtttatatccgcatatgatacgtactaaagatatacaatcggttaagagtattaatcggattatgtttattcctattatctttggagttttgatagttttattcttttcaaatcaaattctttctataattggtggtgaaaaatataccgtttcagcagattttcttaagtacttattacccgcttttgttgctagtttttattctatgatttacggatggcctgtcttaggagctattgataaagtgaaagaaactacaatgacaactatattagcttcgattgtccaaactttgggattaggaatatttatcttgtctgataattttagtttagtaacattagctatttgttcaagtatgtctgaggtggtgttatggattagccgttatctaatttattttaagaaccgttcattatttgttaggagtaagtaa

SEQ ID NO: 21 - DNA, 5310 bp, Streptococcus pneumoniae
aagtttatgaataaaggattatttgaaaaacgttgtaaatatagtattcggaaattttcattaggtgttgcttctgttatgattggagctgcattctttgggacaagtccggttcttgcagatagcgtgcagtctggttccacggcgaacttaccagctgatttagctactgctcttgcaacagcaaaagagaatgatgggcgtgattttgaagcgcctaaggtgggagaagaccaaggttctccagaagttacagatggacctaagacagaagaagaactattagcacttgaaaaagaaaaaccggctgaagaaaaaccaaaagaggataaacctgcagctgctaaacctgaaacacctaagacggtaacccctgaatggcaaacggtagcgaataaagagcaacagggaacagtcactatccgagaagaaaaaggtgtccgctacaaccaactatcctcaactgctcaaaatgataacgcaggcaaaccagccctgtttgaaaagaagggcttgaccgttgatgccaatggaaatgcaactgttgatttaaccttcaaagatgattctgaaaagggcaaatcacgctttggtgtctttttgaaatttaaagataccaagaataatgtttttgtcggttatgacaaggatggctggttctgggagtataaatctccaacaactagcacttggtatagaggtagtcgtgttgctgctcctgaaacaggatcaacaaaccgtctctctatcactctcaagtcagacggtcagctaaatgccagcaataatgatgtcaatctctttgacacagtgactctaccagctgcggtcaatgaccatcttaaaaatgagaagaagattcttctcaaggcgggctcttatgacgatgagcgaacagttgttagcgttaaaacggataaccaagagggggtaaaaacagaggatacccctgctgaaaaagaaacaggtcctgaagttgatgatagcaaggtgacttatgacacgattcagtctaaggtcctcaaagcagtgattgaccaagccttccctcgtgtcaaggaatacagcttgaacgggcatactttgccaggacaggtgcaacagttcaaccaagtctttatcaataaccaccgaatcacccctgaagtcacttataagaaaatcaatgagacaacagcagagtacttgatgaagcttcgcgatgatgctcacttaatcaatgcggaaatgacagtacgcttgcaagttgtagacaatcaattgcactttgatgtgactaagattgtcaaccacaatcaagtcactccaggtcaaaagattgatgacgaaagcaaactactttcttctattagtttcctcggcaatgctttagtctctgtttctagtaatcaaactggtgctaagtttgatggggcaaccatgtcaaacaatacgcatgtcagcggagatgatcatatcgatgtaaccaatccaatgaaggatttggctaagggttacatgtatggatttgtttctacagataagcttgctgctggtgtttggagtaactctcaaaacagctatggtggtggttcgaatgactggactcgtttgacagcttataaagaaacagtcggaaatgccaactatgtaggaatccacagctctgaatggcaatgggaaaaagcttataagggcattgttttcccagaatacacgaaggaacttccaagtgctaaggttgttatcactgaagatgccaatgcagacaagaacgttgattggcaagatggtgccattgcttatcgtagcattatgaacaatcctcaaggttgggaaaaagttaaggatatcacagcttaccgtatcgcgatgaactttggttctcaagcacaaaacccattccttatgaccttggatggtatcaagaaaatcaatctccatacagatggtcttgggcaaggtgttctccttaaaggatatggtagcgaaggccatgactctggtcacttgaactatgctgatattggtaagcgtatcggtggtgtcgaagacttcaagaccctaattgagaaggctaagaaatatggagctcatctaggtatccacgttaacgcttcagaaacttatcctgagtctaaatacttcaatgaaaaaattctccgtaagaatccagatggaagctatagctatggttggaactggctagatcaaggtatcaacattgatgctgcctatgacctagctcatggtcgtttggcacgttgggaagatttgaagaaaaaacttggtgacggtctcgactttatctatgtggacgtttggggtaatggtcaatcaggtgataacggtgcctgggctacccacgttcttgctaaagaaattaacaaacaaggctggcgctttgcgatcgagtggggccatggtggtgagtacgactctaccttccatcactgggcagctgacttgacctacggtggctacaccaataaaggtatcaacagtgccatcacccgctttatccgtaaccaccaaaaagatgcttgggtaggggactacagaagttatggtggtgcagccaactatccactgctaggtggctacagcatgaaagactttgaaggctggcagggaagaagtgactacaatggctatgtaaccaacttatttgcccatgacgtcatgactaagtacttccaacacttcactgtaagtaaatgggaaaatggtacaccggtgactatgaccgataacggtagcacctataaatggactccagaaatgcgagtggaattggtagatgctgacaataataaagtagttgtaactcgtaagtcaaatgatgtcaatagtccacaatatcgcgaacgtacagtaacgctcaacggacgtgtcatccaagatggttcagcttacttgactccttggaactgggatgcaaatggtaagaaactttctactgataaggaaaagatgtactacttcaatacgcaggccggtgcaacaacttggacccttccaagcgattgggcaaagagcaaggtttacctttacaagctaactgaccaaggtaagacagaagagcaagaactaactgtaaaagatggtaaaattaccctagatcttctagcaaatcaaccatacgttctctatcgttcgaaacaaactaatcctgaaatgtcatggagtgaaggcatgcacatctatgaccaaggatttaatagcggtaccttgaaacattggaccatttcaggcgatgcttctaaggcagaaattgtcaagtctcaaggggcaaacgatatgcttcgtattcaaggaaacaaagaaaaagttagtctcactcagaaattaactggcttgaaaccaaataccaagtatgccgtttatgttggtgtagataaccgtagtaatgccaaggcaagtatcactgtgaatactggtgaaaaagaagtgactacttataccaataagtctctcgcgctcaactatgttaaggcctacgcccacaatacacgtcgtgacaatgctacagttgacgatacaagttacttccaaaacatgtacgccttctttacaactggagcggacgtctcaaatgttactctgacattgagtcgtgaagctggtgatcaagcaacttactttgatgaaattcgtacctttgaaaacaattcaagcatgtacggagacaagcatgatacaggtaaaggcaccttcaagcaagactttgaaaatgttgctcagggtatcttcccatttgtagtgggtggtgtcgaaggtgttgaagataaccgcactcacttgtctgaaaaacacaatccatatacacaacgtggttggaatggtaagaaagtcgatgatgttatcgaaggaaattggtcactcaagacaaatggactagtgagccgtcgtaacttggtttaccaaaccatcccacaaaacttccgttttgaagcaggtaagacctaccgtgtaacctttgaatacgaagcaggatcagacaatacctatgcttttgtagtcggtaagggagaattccagtcaggtcgtcgtggtactcaagcaagcaacttggaaatgcatgaattgccaaatacttggacagattctaagaaagccaagaaggcaaccttccttgtgacaggtgcagaaacaggcgatacttgggtaggtatctactcaactggaaatgcaagtaatactcgtggtgattctggtggaaatgccaacttccgtggttataacgacttcatgatggataatcttcaaatcgaagaaattaccctaacaggtaagatgttgacagaaaatgctctgaagaactacttgccaacggttgccatgactaactacaccaaagagtctatggatgctttgaaagaggcggtctttaacctcagtcaggccgatgatgatatcagtgtggaagaagcgcgtgcagagattgccaagattgaagctttgaagaatgctttggttcagaagaagacggctttggtagcagatgactttgcaagtcttacagctcctgctcaggctcaagaaggtcttgcaaatgcctttgatggcaatgtgtctagtctatggcatacatcttggaatggtggagatgtaggcaagcctgcaactatggtcttgaaagaaccaactgaaatcacaggacttcgctatgttccgcgtggatcaggttcaaatggtaacttgcgagatgtgaaacttgttgtgacagatgagtctggcaaggagcatacctttactgcaactgattggccaaataacaacaaaccaaaagatattgactttggtaagacaatcaaggctaagaaaattgtccttactggtaccaagacatacggagatggtggagataaataccaatctgcagcggaacttatctttactcgtccacaggtagcagaaacacctcttgacttgtcaggctatgaagcagctttggttaaggctcagaaattaacagacaaagacaatcaagaggaagtagctagcgttcaggcaagcatgaaatatgcgacggataaccatctcttgacggaaagaatggtggaatactttgcagattatctcaaccaattaaaagattctgctacgaaaccagatgctccaactgtagagaaacctgagtttaaacttagatctttagcttccgagcaaggtaagacgccagattataagcaagaaatagctagaccagaaacacctgaacaaatcttgccagcaacaggtgagagtcaatctgacacagccctcatcctagcaagtgttagtctagccctatctgctctctttgtagtaaaaacgaagaaagactag

SEQ ID NO: 22 - DNA, 717 bp, Streptococcus pneumoniae
aagggagaggatgaacctatgagaaaatttaaaatctttttatttatcgaagcctgtcttctgacaggagctctgattttgatggtatcagagcatttttcgcgttttctgctgatactattcctctttttgcttttgattcgctactacactggtaaagagggaaataatcttcttttagtagcggcaaccattctcttctttttcatcgttatgctcaatccttttgtgattctagctatttttgttgcggttatctatagcctctttcttctttacccgatgatgaaccaggaaaaagagcagaccaatttggtttttgaagaggtcgtgacggttaagaaggagaaaaatcgttggtttggaaatcttcatcatttttcaagctaccagacttgccaattcgatgatatcaatctctttcgcttcatgggcaaggacactattcatctggagagggtcatcttaaccaatcatgacaatgtcattatcctcagaaagatggtaggaacgaccaaaatcatcgtacctgtagatgtggaagtcagtctcagcgttaactgtctctatggggatttgatttttttcaaccagcccaagcgagccctccgcaatgaacactatcatcaagaaacaaaagactatctcaagagtaacaagagtgtcaagattttcttgaccactatgattggtgatgtggaggtggttagaggatga

SEQ ID NO: 23 - DNA, 252 bp, Streptococcus pneumoniae
gaggatacaataatgaagaaaactgtttataaaaaattgggtatttcaattattgcgagtactttattggctagccagttatcgacagtatctgctttgagtgttatttctagtacaggtgaagaatatgaggtaagtgagacactagaaaaaggtccagagtctaatgattcttcattatctgagatttcaccaacgtatggttcatactaccaaaagcaatcagaagtattatcggtaatgatgatttga

SEQ ID NO: 24 - DNA, 2361 bp, Streptococcus pneumoniae
acattcaaagacaaggaaataaagatgaataagaaaatattagaaacattagagttcgataaggtcaaggccttgtttgagcctcatttgttgaccgagcagggcttggagcaattgagacaactggctccgactgccaaagcagataaaatcaaacaggcttttgctgagatgaaggaaatgcaggctcttttcgtcgagcaaccgcattttactattctctcaactaaggaaattgcaggagtctgcaagaggttggagatgggagcggatctcaatatcgaggagttcctactcttgaaacgcgtgcttcttgccagccgagaacttcaaaatttttacaccaatctggaaaatgtcagcttggaagaattagccctttggtttgagaaattacatgattttccgcaattacaaggaaatcttcaggcctttaatgatgcgggtttcattgaaaattttgccagtgaagaattggcgcgaatccgtcgaaaaatacatgatagcgagagtcaggtacgcgatgttttacaagacttgctcaagcaaaaagcgcagctgttgacggaaggaattgttgctagcagaaatggccgtcaggttttaccagtcaaaaacacctaccgcaataagattgcaggtgtcgttcatgatatttctgctagtggaaacaccgtctatatcgaaccccgtgaggtagtcaaactgagcgaagaaattgctagtctgcgagcagatgagcgctatgaaatgcttcgcattctccaagaaatttctgagcgtgtccgccctcatgcggctgagattgctaatgacgcttggattatcggtcatctggacttgattcgtgccaaggttcgatttatccaagaaagacaagcagtcgtgcctcagctgtcagaaaatcaagagattcaactgctccatgtctgccatcctttggtcaaaaatgccgtcgcaaatgatgtctattttggtcaagatttaacagctattgtcattacaggtcccaatacaggtgggaagaccatcatgctcaaaactctgggcttgacacaggtcatggcccagtcaggattgccgattttagcagacaagggaagtcgtgttggtatttttgaagaaatctttgctgatattggagatgagcagtctattgagcagagcttgtctaccttctctagtcatatgaccaatatcgtggatattcttggcaaggtcaaccaacattcactcttacttttggatgagttgggggctggtactgatccccaagagggagcagcccttgccatggctattctggaggaccttcgcctgcgtcaaatcaagaccatggcgacgacccactatccagaactcaaggcctacggtattgagacagcctttgtgcaaaatgccagtatggagtttgatactgcaactcttcgcccgacctatcgctttatgcagggtgttcctggccgaagtaatgcctttgaaattgccaaacgtctaggcctatctgaagttatcgtaggagatgccagtcagcagatcgatcaggacaatgacgtcaatcgtatcattgagcaattagaagagcagacgctggaaagccgcaaacgtttggacaatatccgtgaggtggagcaagaaaatctcaagatgaaccgtgcgctaaaaaaactctacaacgagcttaatcgtgaaaaggaaaccgagcttaacaaggcgcgtgaacaggctgctgagattgtggatatggccctaagtgaaagtgaccagattctcaaaaatctccacagtaaatcccaactcaagccccacgaaatcattgaagccaaggccaagttgaaaaaattggctcctgaaaaagtggacttgtctaaaaataaggtccttcaaaaggccaagaaaaaacgagctccaaaggtgggagatgatatcgtggttctcagttatggtcagcgtggtaccttgaccagtcaactcaaggacggtcgctgggaagcccaagttggcttgattaagatgaccttggaagagaaagagtttgatcttgttcaagcccagcaagaaaaaccagtcaagaagaaacaggtcaatgttgtgaaacgaacttctgggcgaggacctcaagctagactggatcttcgaggcaagcgctatgaagaagccatgaatgagctagataccttcatcgaccaagccttgcttaacaatatggctcaagttgatatcatccatggtatcggaacaggagtcatccgtgaaggagttaccaaatacttgcaaagaaacaaacatgtcaagagtttcggctatgccccacaaaatgctggaggcagtggtgcgactattgtcacttttaaaggatag

SEQ ID NO: 25 - DNA, 294 bp, Streptococcus pneumoniae
cagctgaggcacgactgcttgtctttcttggataaatcgaaccttggcacgaatcaagtccagatgaccgataatccaagcgtcattagcaatctcagccgcatgagggcggacacgctcagaaatttcttggagaatgcgaagcatttcatagcgctcatctgctcgcagactagcaatttcttcgctcagtttgactacctcacggggttcgatatagacggtgtttccactagcagaaatatcatgaacgacacctgcaatcttattgcggtaggtgtttttgactggtaa

SEQ ID NO: 26 - DNA, 915 bp, Streptococcus pneumoniae
ttattggaggttaggatgaaaaaactccccttagtattttcaggttgtttgctaggtttggcaggagctggaaatcttattttagatacgttgccggttctatcccatctttttagtctgattggtttggttttatggatttactttctaattctgcatctctttaattggaaagaaaccaagcaagaattgaccaagccccctcttttgtcaggaatggcaacctttcctatggctgggatgattttatcgacctatgtctttcgcgtattctcttatcttcctttggtagcacaagggatttggtggttttcatttctcttggatttgaccttgattgctggttttaccatcaagtttgcttgtccagggcggagggttcatgccactccaagctggacggttctctatgtggggatagcagtggctgccttgacctatcctctggtaggtattatcgaaattgcctatgcgaccttgagttttggttttctcttgaccttctatctctatccccttatttatagcgatttaaagaaacatccactcccactagccttgcttggacaagaaggaatctactgtgctcctttctctctactcttggcttctctagttcgagtaggaggaaccagcctgccgacttgggtcttgattgtcatgattttggcttctcaatccttctttttctttgttttaactcgtctgcccaacattttaaaacaaggttttcaaccagccttctcagccctcaccttcccaaccattatcacagcgacctcgctcaagatggctcagggaattttgaaacttccatttctggattacctggtattggctgaaaccattatatgcctaactattttattctttgtactaggtgcttatctgatttggttacgaaaaaaggtctag

SEQ ID NO: 27 - DNA, 849 bp, Streptococcus pneumoniae
tctatgtatcttattgaaattttaaaatctatcttcttcggaattgttgaaggaattacggaatggttgccgatttccagtacaggtcacttgattttagcagaggaattcatccaataccaaaatcaaaatgaagcctttatgtccatgtttaatgtcgtgattcagcttggtgctattttagcagttatggtgatttattttaacaagctcaatccttttaaaccgaccaaggacaaacaggaagttcgtaagacttggagactatggttgaaggtcttgattgctactttacctttacttggtgtctttaaatttgatgattggtttgatacccacttccataacatggtttcagttgctctcatgttgattatctacggggttgccttcatctatttggaaaagcgcaataaagcgcgtgctatcgagccaagtgtaacagagttggacaagcttccttatacgaccgctttctatatcggactcttccaagttcttgctcttttaccagggactagccgttcaggtgcaacgattgtcggtggtttgttaaatggaaccagtcgttcagttgtgacagaatttaccttctatcttgggattcctgttatgtttggagctagtgccttaaagattttcaaatttgtgaaagccggagaactcttgagctttgggcaattgtttttgctcttggtcgcgatgggagtagcttttgcggtcagcatggtggctattcgcttcttgaccagctatgtgaaaaaacacgacttcaccctttttggtaaataccgtatcgtgcttggtagtgttttgctactttacagttttgtccgtttatttgtataa

SEQ ID NO: 28 - DNA, 939 bp, Streptococcus pneumoniae
aatgatgagtttgaagataaagggatgctgataaaaatggtaaaaacaaaaaagcaaaaacgaaataatctcctattaggagtggtatttttcattggaatggcggtaatggcgtatccgctggtgtctcgcttgtattatcgagtggaatcaaatcaacaaattgctgactttgataaggaaaaagcaacgttggatgaggctgacattgatgaacgaatgaaattggcacaagccttcaatgactctttgaataatgtagtgagtggcgatccttggtcggaagaaatgaagaaaaaagggcgagcagagtatgcacgtatgttagaaatccatgagcggatggggcatgtggaaatccccgttattgacgtggatttgccggtttatgctggtactgctgaagaggtattgcagcaaggggctgggcatctagagggaacttctctgccgatcggaggcaattcgacccatgcggtgattacggcacatacaggtttgccaacagctaagatgtttacggatttgaccaaacttaaagttggggataagttttatgtgcacaatatcaaggaagtgatggcctatcaagtggatcaagtaaaggtgattgagccgacgaactttgatgatttattgattgtaccaggtcatgattatgtgaccttgctgacttgtacgccatacatgatcaatacccatcgtctattggttcgggggcatcggataccgtacgtagcagaggttgaggaagaatttattgcagcaaacaaactcagtcatctctatcgctacctgttttatgtggcagttggtttgattgtgattcttttatggattattcgacgcttgcgcaagaagaaaaaacaaccggaaaaggctttgaaggcgctgaaagcagcaaggaaggaagtgaaggtggaggatggacaacagtag

SEQ ID NO: 29 - DNA, 903 bp, Streptococcus pneumoniae
aggtggaggatggacaacagtagacgttcacgaaaaaaaggcacaaaaaagaagaaacatccgctgatccttcttctgattttcttagtaggattcgccgttgcgatatatccattggtgtctcgttattattatcgtattgagtcaaacgaggttattaaagagtttgatgagacggtttcccagatggataaggcagaacttgaggagcgttggcgcttggctcaagccttcaatgcgaccttgaaaccatctgaaattcttgatccttttacagagcaagagaaaaagaaaggcgtctcagaatatgccaatatgctaaaggtccatgagcggattggctatgtggaaattcctgcgattgatcaggaaattccgatgtatgtcggaacgagtgaggacattcttcagaaaggggcagggctgttagaaggggcttcgctgcctgttggaggtgaaaatacccatacagtgatcactgctcacagaggattgccaacggcagaattgttcagtcaattggataagatgaaaaaaggggatatcttttatcttcacgttttagatcaggtgttggcctaccaagtggatcagatagtgacggtggagccgaatgactttgagcctgtcttgattcaacatggggaagattatgcgaccttgttgacttgtacaccgtatatgattaacagtcatcgtctgttggtacgtgggaagcggattccgtatacggcaccaattgcagagcggaatcgagcggtgagagagcgtgggcaattctggttgtggttattactaggagcgatggcggtcatccttctcttgctgtatcgcgtgtatcgtaatcgacggattgtcaaaggactagaaaagcaattggaggggcgtcatgtcaaggactaa

SEQ ID NO: 30 - DNA, 1347 bp, Streptococcus pneumoniae
aaaataaaaaaaggagttccggtgatgaacaatattttagcgtttttagaaacaaaagtcgctccgtttggtgaaaaagttggcaaccaacggcatttgaaagctattcgtgaaggatttatgatggcaatgcctttgattttagtcggctctttatttcttattctaatcagttggcctcaagaggcttttacaaattggctgaatagtgttggattgctaagtatcttgacaactatgaatcagtcaacagtagcgattatctccttggtcgcttgtttcggtattgcctacaggttgtcggaaggatatggtacagatggtccgtcggcagggatcatagccttatccagttttgtattgatggcacctcgtttttcgagtatggtttatgataaaaatggggagcaggtcaagcagttatttggcggcgcaataccattttctagcctgaatgcatcttctttgtttatggcgattactattggattggttacagcagagatttatcgtatgtttatccagcgcggaattacgataaaaatgccaagtggtgtcccagatgtagtaagtaaatcattttcagctcttttatctggttttactacttttgttttgtgggctttggtcttaaaaggtcttgaagcggcaggagttgcaggaggtctcaacggactcctaggtgcaattgttggaacaccgcttaagttaattgcaggaacgcttccaggtatgattctatgtgttattgtaaactcattcttttggttctgtggagttaatgggggacaagttttaaatgcttttgtagacccagtttggttacaatttactacagaaaaccaagaagctgtggctgcaggacaaacactccaacacattattacattaccgtttaaagatttatttgtatttattggtggcggtggagcgactattggtcttgcgatttgtctcttcctatttagtaagagtcgtgcgaataaaacattaggtaagctagctattataccgtctatttttaatatcaatacagctattctatttacgtttccaacagttttaaatccgattatgctgattccgtttattgctactcctacaatcaatgccttgattacctatgtatcaatggctgtaggattagtaccctatacaacaggtgtaatccttccgtggacaatgccaccgattataggaggcttccttgcaacaggggctagttggcgaggagctctattacaagttgttttgattttggtttctgtagcaatttattatccattcttcaaaattgcagataaacgcaatcttgaaaaagaaaaagctactgttggagggaaataa

SEQ ID NO: 31 - DNA, 1701 bp, Streptococcus pneumoniae
attttttataggaggagttttatggataagctagtcgctgccattgaaaagcaacaagggaaatttgaaaaaatttctactaataactatatgatggctattaaagatggattcattgctactatgcctttaattatgttttcaagctttttgatgattattattatgattcctaaaaatttcggagtagagttaccgagtccagctattgtctggatgagaaaagtgtatatgttaaccatgggagttttgggtattattgtttcagggactgttggaaagtcattagttggaaatgttaacagaaaaatgcctcacggaaaggtaataaatgatatttctgcaatgttggcagccatatgtagttatctggtattaactgtaacgcttgtagttgatgagaagacgggatctacaagtttgtcgacaaactatttaggatctcaaggattgataacttcgtttgtcagtgcctttattactgtaaatgtttaccgattctgtattaagcgagacattactattcatttacctaaggaagttcctggggctatatcacaagcttttagagatattttccctttttcttttgttttacttattagtggtttgttagatattgtatctcggtttagtttagatgttccttttgcccaagtatttcaacaactattgactcctatttttaagggggcagaatcatatcctgctatgatgttgatttggtttatgtgtgctttgctttggtttgttggaattcatggaccatctattgtcttacctgctgttacagctttgcaactgagcaatatggaagagaatgctcaacttcttgcaaatgggcagttcccttatcattctttaacacctaatttcgggaattatatcgctgctattggaggaacgggggctacctttgttgtaccatttattttgattttctttatgcggtctaaacaattaaaatcggtaggtaaagctacaattactcctgttttatttgcggtaaatgaacctcttctatttggtatgcctgttattttgaatccctatctttttgtcccttttttgatgactccaccagtgaatgtatttctaggaaaggtctttattgatttctttggaatgaatggattttatatccagttaccttggacctttcctggtcccttgggattgttaattggaacgaattttcaacttatctcctttgtatttttatctttgattttagttgtcgacatattgatttatttgccattctgtagagcgtatgatagacagttactggtgaaagaagatattgcaagctcaaatgatattattttagaggaggatacaagtgaaataattcctggtgagatagatgaaataaaaagtaaggagttgaaagtactggttctttgtgcagggtctggaacaagtgcgcaattagccaatgcaattaacgagggggctaacttaacagaggttagagtgattgcgaattcaggagcgtacggagctcattatgatattatgggtgtttatgatttaattattctggccccacaagttcggagttattatagagagatgaaggtggatgcagaaagattaggtattcagatagttgctaccagaggaatggaatatattcatttaacaaagagtccaagtaaagccttacaatttgtattggagcattaccaagctgtgtag

SEQ ID NO: 32 - DNA, 1704 bp, Streptococcus pneumoniae
gaagcgaatgaagagagtaagatgaaagaagctataattgagtggaaggatttctctttccggtatgaaacacaacaagaaccgaccttgcaagggatagacttgaccatttacaagggagagaaagtcttaattgttggaccatctgggtcaggtaaatctaccttgggtcagtgtttgaatgggattattcccaatatttacaagggtcagacatatggagaatttttgataaagggtcaagtagcctttgatatgagcatctatgataagtctcatctggttagcacagttttgcaggatacagatgggcagtttattggcttgtctgtggcagaagatttggcgtttgctctggaaaatgatgtgacagccctagatgagatgaaaggtcgtgtttataaatgggctgaaaagctggaccttcttcctttactggatcagcgtcctcaggatttgtcaggtggacaaaagcagcgagtcagtctggctggtgtcttgattgatgaaagtccgattctcttgtttgatgagccactcgccaatctagatcccaagtcaggtcaggatattatcgaattgattgaccagattcataaggaagaggggacgacgactcttattatcgagcaccgtttggaggacgttctgcatcgccctgtggatcggattgtcttgataaacgatggtcgtatcctttttaatgggagccctgaccagttgcttgcgactgatttattgactcaaaatggaattcgagaacccctttatctaacgactctccgtcaattaggtgtggacttagtcaaggaagaacaattagcgaatctggataacttgtctatctcaaaaggtcaggttcagttgcagaatgaactggcaaaagaaaccccagcattgcagtcactctttagactagaggaagtatctttttcttatgatgatagaccgattttaaaatccctacatttagatattaaaaagggtgaaaagattgctattgtcggaaaaaatggagcagggaaatcaactctagccaaggctataagtagctttattcagacggaaggacgctatctttgggaaaaacaggatataaaaggcgattctgttgcagagcgggcggaacgagtaggatatgtgctacaaaatcctaatcaaatgatttcaaccaatatgatttttgatgaggtggctctagggctccgtttgcgaggtgtggatgagaaggaaattgaaacgagagtatatgaaaccttgaaaatctgtggactttatgaattccgtaattggcctatttctgccctgtcatttggtcagaaaaaacgtgtcaccattgcttcaattttggtcttaggagctgaaattattctcctagatgaaccgactgcaggtcaagatcagaagaactatactgagattatggaatttctcgaagagttacatcaaaaagggcataccattgtcatgattacccatgatatgcaattgatgctggattattcagaccgggtccttgtcatggtggatggagaattgattgccgatactgttccagccagtctgttgagcgatcctgagctgttagtaaaagccaatctaaaagaaacctccatctttaacttggctaagaaactagatgtggatccactggatttaacggcattttacaaagaaaggagagagggatgcaagctaaattaa

SEQ ID NO: 33 - DNA, 1668 bp, Streptococcus pneumoniae
gagatattccgcgattatttttcggaggaaaaagaaatgtccattaattggcaggaaattttatttcactttttaggtggtctggggctattcttatatagcatcaagaccatgggagacggtttacaacaagctgctggagatcgccttcgtttttacattgacaaatatactagtaatcctttctttggagttctggttggtattgggatgactgctctaattcagtctagttctggtgtaacagttatcacagtcggcctggtcagtgccggtctcttaaccttacgtcaggctatcgggattgtcatgggtgctaatattgggacaactgtcacatcctttctcatcggttttaaattaggtaactatgccctacctatgctctttatcggtgccgtctgtcttttttttacgaaaaatcggacagtcaataatatcggacgcatcctctttggtgtcggtggtatcttttttgccctcaatctcatgagcggcgcaatggctccactcaaggatttacaggtctttaaggactatatgattgagctaagtaagaatcctgttttgggtgtctttgtcggtactggcttgaccttgctaattcaagcttcttcggctaccattgggattttacaaaacctctacgccggcaatctaattgatctacagggagctttgccagttctatttggtgacaatatcgggacaaccattacagccatcattgcctctttaggggctaatattgcagctaaacgggtagcaggagctcatgttgccttcaacgttatcggaacagttgtctgcgttatttttctagttccttttactgtcctgattcattggtttgaagctacgctaaatctagcaccggaaatgaccatcgcctttgctcacggaacctttaatattaccaacaccattgtccaatttccatttatcggagctctggcttactttgtaaccaagattattcctggagaggacgaggttgtcaaatacgaacccttatatcttgatgaacatttcatcaaacaggccccatctatcgctctaggaaatgctaagaaagagctcttgcacttaggaaactacgctgctaaagcctttgacctttcctataagtacatcattgacttggatgaaaaagttgctgaaaaagggcataaaaccgaagaagcaattaacaccatcgatgagcaattaacacgttatctcattgccctttcaagcgaagctctcagccaaaaagaaagtgaagtgcttaccaatatccttgattcctcccgtgatttggaacggattggagaccacacggaggctctactcaatctgactgactatcttcaacggaaaaatgttgaattttctgatgccgccttgaaagaattagaggaagtttaccgccaaactagtgactttatcaaagatgctctggatagtgtggaaaacaatgatattgaaaaagcacgcagtcttgtagaacgtcatgaagcaatcaataagatagaacgtgttctcagaaaaacccacatcaaacgcctcaacaaaggcgaatgttcaacacaagctggggtcaactttatcgacatcatctcacactacactcgtgtatcagaccacgctatgaaccttgctgaaaaggtttttgcagaacaaatctaa

SEQ ID NO: 34 - DNA, 4989 bp, Streptococcus pneumoniae
gaggagaaaatgaagaatccattttttgaaagacgttgtcgttacagtattcgtaagttatcagtaggagcctgctcgctgatgattggtgctgttttatttgctggtccagccttggctgaagaaactgcagttcctgaaaatagcggagctaatacagagcttgtttcaggagagagtgagcattcgaccaatgaagctgataagcagaatgaaggggaacatgctagagaaaacaagctagaaaaggcagaaggagtagcgatagcatctgaaactgcttcgccagcaagcaatgaagctgcaactactgaaactgcagaagcagctagcgcagctaaaccagaggaaaaagcaagtgaggtggttgcagaaacaccatctgcagaagcaaaacctaagtctgacaaggaaacagaagcaaagcccgaagcaactaaccaaggggatgagtctaaaccagcagcagaagctaataagactgaaaaagaagtccagccagatgtccctaaaaatacagaaaaaacattaaaaccaaaggaaatcaaatttaattcttgggaagaattgttaaaatgggaaccaggtgctcgtgaagatgatgctattaaccgcggatctgttgtcctcgcttcacgtcggacaggtcatttagtcaatgaaaaagctagcaaggaagcaaaagttcaagccttatcaaacaccaattctaaagcaaaagaccatgcttctgttggtggagaagagttcaaggcctatgcttttgactattggcaatatctagattcaatggtcttctgggaaggtctcgtaccaactcctgacgttattgatgcaggtcaccgtaacggggttcctgtatacggtacactcttcttcaactggtctaatagtattgcagatcaagaaagatttgctgaagctttgaagcaagacgcagatggtagcttcccaattgcccgtaaattggtagacatggccaagtattatggctatgatggctatttcatcaaccaagaaacaactggagatttggttaaacctcttggagaaaagatgcgccagtttatgctctatagcaaggaatatgctgctaaggtaaaccatccaatcaagtattcttggtacgatgccatgacctataactatggacgttatcatcaagatggtttgggagaatacaactaccaattcatgcaaccagaaggagataaggttccggcagataacttctttgctaactttaactgggataaggctaaaaatgattacactattgcaactgccaactggattggtcgtaatccttatgatgtatttgcaggtttggaattgcaacagggtggttcctacaagacaaaggttaagtggaatgacattttagacgaaaatgggaaattgcgcctttctcttggtttatttgccccagataccattacaagtttaggaaaaactggtgaagattatcataaaaatgaagatatcttctttacaggttatcaaggagaccctactggccaaaaaccaggtgacaaagattggtatggtattgctaacctagttgcggaccgtacgccagcggtaggtaatacttttactacttcttttaatacaggtcatggtaaaaaatggttcgtagatggtaaggtttctaaggattctgagtggaattatcgttcagtatcaggtgttcttccaacatggcgctggtggcagacttcaacaggggaaaaacttcgtgcagaatatgattttacagatgcctataatggcggaaattcccttaaattctctggtgatgtagccggtaagacagatcaggatgtgagactttattctactaagttagaagtaactgagaagaccaaacttcgtgttgcccacaagggaggaaaaggttctaaagtttatatggcattctctacaactccagactacaaattcgatgatgcagatgcatggaaagagctaaccctttctgacaactggacaaatgaagaatttgatcttagctcactagcgggtaaaaccatctatgcagtcaaactatttttcgagcatgaaggtgctgtaaaagattatcagtttaacctaggacaattaactatctcggacaatcaccaagagccacaatcgccgacaagcttttctgtagtgaaacaatctcttaaaaatgcccaagaagcggaagcagttgtgcaatttaaaggcaacaaggatgcagatttctatgaagtttatgaaaaagatggagacagctggaaattactaactggctcatcttctacaactatttatctaccaaaagttagccgctcagcaagtgctcagggtacaactcaagaactgaaggttgtagcagtcggtaaaaatggagttcgttcagaagctgcaaccacaacctttgattggggtatgactgtaaaagataccagcctaccaaaaccactagctgaaaatatcgttccaggtgcaacagttattgatagtactttccctaagactgaaggtggagaaggtattgaaggtatgttgaacggtaccattactagcttgtcagataaatggtcttcagctcagttgagtggtagtgtggatattcgtttgaccaagccacgtaccgttgttagatgggtcatggatcatgcaggagctggtggtgagtctgttaacgatggcttgatgaacactaaagactttgacctttattataaagatgcagatggtgagtggaagctagctaaggaagtccgtggtaacaaagcacacgtgacagatatcactcttgataaaccaatcactgctcaagactggcgcttgaatgttgtcacttctgacaatggaactccatggaaggctattcgtatctataactggaaaatgtatgaaaagcttgatactgagagtgtcaatattccgatggccaaggctgcagcccgttctctaggcaataacaaggtacaagttggctttgcagatgtaccggctggagcaactattaccgtttatgataatccaaattctcaaactccgctcgcaaccttgaagagcgaagttggaggagacctagcaagtgcaccattggatttgacaaatcaatctggtcttctttattatcgtacccagttgccaggcaaggaaattagtaatgtcctagcagtttccgttccaaaagatgacagaagaatcaagtcagtcagcctagaaacaggacctaagaaaacaagctacgccgaaggggaggatttggaccttagaggtggtgttcttcgagttcagtatgaaggaggaactgaggacgaactcattcgcctaactcacgcaggtgtatcagtatcaggttttgatacgcatcataagggagaacagaatcttactctccaatatttgggacaaccggtaaatgctaatttgtcagtgactgtcactggccaagacgaagcaagtccgaaaactattttgggaattgaagtaagtcaggaaccgaaaaaagattacctagttggtgatagcttagacttgtctgaaggacgctttgcagtggcttatagcaatgacaccatggaagaacattcctttactgatgagggagttgaaatttctggttacgatgctcaaaagactggtcgtcaaaccttgacgcttcattaccaaggccatgaagttagctttgatgttttggtatctccaaaagcagcattgaacgatgagtacctcaaacaaaaattagcagaagttgaagctgctaagaacaaggtggtctataactttgcttcatcagaagtaaaagaagccttcttgaaagcaattgaagcggccgaacaagtgttgaaagaccatgaaactagcacccaagatcaagtcaatgaccgacttaataaattgacagaagctcataaagctctgaatggtcaagagaaatttacggaagaaaagacagagcttgatcgcttaacaggtgaggttcaagaactcttggctgccaaaccaaaccatccttcaggttctgccctagctccgcttcttgagaaaaacaaggccttggttgaaaaagtagatttgagtccagaagagcttacaacagcgaaacagagtctaaaagatctggttgctttattgaaagaagacaagccagcagtcttttctgatagtaaaacaggtgttgaagtacacttctcaaataaagagaagactgtcatcaagggtttgaaagtagagcgtgttcaagcaagtgctgaagagaagaaatactttgctggagaagatgctcatgtctttgaaatagaaggtttggatgaaaaaggtcaagatgttgatctctcttatgcttctattgtgaaaatcccaattgaaaaagataagaaagttaagaaagtatttttcttacctgaaggcaaagaggcagtagaattggcttttgaacaaacggatagtcatgttatctttacagcacctcactttactcattatgcctttgtttatgaatctgctgaaaaaccacaacctgctaaaccagcaccacaaaacacagtccttccaaaacctacttatcaaccgacttctgatcaacaaaaggctcctaaattggaagttcaagaggaaaaggttgcctttcatcgtcaagagcatgaaaatactgagatgctagttggggaacaacgagtcatcatacagggacgagatggactgttaagacatgtctttgaagttgatgaaaacggtcagcgtcgtcttcgttcaacagaagtcatccaagaagcgattccagaaattgttgaaattggaacaaaagtaaaaacagtaccagcagtagtagctacacaggaaaaaccagctcaaaatacagcagttaaatcagaagaagcaagcaaacaattgccaaatacaggaacagctgatgctaatgaagccctaatagcaggcttagccagccttggtcttgctagtttagccttgaccttgagacggaaaagagaagataaagattaa

SEQ ID NO: 35 - DNA, 1029 bp, Streptococcus pneumoniae
gcaagcttccttcctctgattttcaaacaaaaatctctcattgcttacattgttctctcaagcttattggtcactattatcaatataggtggttcttactatctccaaggaatcttggatgaatacattccaaatcagatgaaatcaactttaggaatcatctcagttggtctggttatcacctatatcctccaacaagtcatgagcttctccagagattatctcctaaccgttctgagtcagagattaagtattgatgtgattttatcctatattcgccatatttttgaacttcccatgtctttctttgcgacacgtcgtacaggagaaatcatttcacgattcacagatgctaactctattatagatgccttggcttctaccattctttctctttttctggatgtttctattctgattcttgtaggaggcgtcttactggcacaaaaccctaatctcttccttctttctcttatttccattcctatatacatgttcatcatcttttcttttatgaaacctttcgaaaaaatgaaccatgatgtcatgcaaagtaattctatggttagctctgccattatcgaagatatcaacgggattgaaactataaagtcgctcacgagtgaagaaaatcgctatcaaaatatagacagcgaatttgtagattatttggaaaaatcctttaagctcagtaaatattctattttacaaacgagtttaaagcagggaacaaaattagttctgaatatccttatcctatggtttggcgctcaattagtcatgtcaagtaaaatttctatcggtcagctgattacctttaacacacttttttcttactttacaactcctatggaaaatattatcaacctccaaaccaaactccaatctgcgaaggtcgctaataaccgtttgaacgaagtctatctagtcgaatctgaatttcaagttcaagaaaaccctgttcattcacattttttgatgggcgatattgaatttgatgacctttcttataagtatggttttggatga

SEQ ID NO: 36 - DNA, 288 bp, Streptococcus pneumoniae
ggtcttggggtaaaaaaacaaaaggcttgcttttcagccatagaggaggtcatcatgtataaacacttatttttcctagattccaaaactttagatcggttgacaccctatattctagtcttggcttctgacaccattgcttttaatgtttttgtgctaacctttgtatctgcggtggtttttaatttcctaaattccatgctagctttaatggctatattcataggggctggctatgtggtcggattttggttactaatactcaatgaaaatcaaagagcaaactag

SEQ ID NO: 37 - DNA, 648 bp, Streptococcus pneumoniae
cgtgtaggaagtctgtttgttgaggaggataattttatggagttttttgataaatttcatgccttgtgttttggatttttagtactaataattgtcattacagttccttatacgattaaccatgggggtttttttcaaaatgaatctgcattgattcttgtaagtcttcttgtaacctcgctgagtgttgcttatgctagaaagtttgaaatgatttcttttgggatgttaagcaagaaacaacttttgcttttcattgcaatctttcttctaagtgtacttgagacgctggtttatattcatttcttcgctgtttcttctggctcaggggtccaacacttggcggaagtcagcagaggaatttccctgtctttgattttgactacctcagtttttggccccatccaggaggaactcattttcagaggacttcttcaaggtgcggtttttgacaattcttggttagggcttgtgctaacttcctctctcttttctttcatgcatggaccttctaatgtcccttcgtttattttttatctacttgggggtttgttgctgggctttgcttataaaaagagtcaaaacctatgggtttctactctagtccatatgctttacaacagttggccactcttatattatttataa

SEQ ID NO: 38 - DNA, 1848 bp, Streptococcus pneumoniae
gagaataccatgagttataaagatacggtacaaaaaatcctcgatgtaattggaggtgaaaaaaatgtcaatagagttacccattgtgtaacacgtttaagattagaattaaaagatgaaaatttagtcaatgatgatgatgtgaagaagataccaggtgtaataggtattatgaaaaagaatggacaatatcaaattatacttggtaatgatgtagctaattattataaagaattcgttaaacttggcaattttgaatccgattcagttgttcaagggcacaaagggaatattttagaaagaatcattgagtatatcgctggttccatgactccaatcattccagcaatgttagggggaggtatgttgaaagtcttggtaatcattttaccaatgcttggtatattgcaatcagattctcagactattgcttttttgacattttttggggatgctccatattatttcttaccgctgttattagcttattctgcatcacaaaaattaaaagtaacatctacattagctatgtctgtagcaggtgtacttctccatccaaattttgttcaaatggtgcaatcagggaatcctcttagtttatttggtgcacctgtgacaccagctagttatggttcatcagtcgttccaattcttattatggtttggttgatgaaatatattgaaaaaataattgctaaattaacactagctattactaagagttttttgcaacctacgctagtattattagtatcaagctgtattgccttagttgtagtcggacctattggagtaattgttggtgaaggattatcaaatctagttgggcaaatgtatggtgtagctggatggcttacattagctattcttggtgctattatgccatttattgttatgactggaatgcattgggcttttgcacctatttttttggcggcatctattgctactccagacgtattaattcttccagcaatgttagggtcaaacttagctcaaggggctgcttcgatggctgttgcattaaagagtaaaaataataatacaaaacaaattgcttttgcagcaggtttctcagccttacttgcagggattaccgaacctgcattatatggtgtgactttaaaatataaaaaaccgctttatgcagctatgattggtggtggattagcgggattatttgcaggtcttactagtgttaaagcatatctatttgctgtcccatctttgatagcgttgcctcaatttatttattctgatgtgccatcaaatattgtaaatgctttaattgtggcggtcatttcggttgttattacctttgtattagcttatatatttggaatcgatgaagaagagagttctagcaatttagaagttgaagctggagtttcaaataaaaaaatgatattttctcctatatcaggagaaatcattccgttaagcgatgtccaggataaaacattttcagataaactaattggagacggagtagcgattatcccaagtgaaggtaaggtttatgcaccatttgatgggaaaattacaaatatttttccgactaagcacgcaattggattgaagagtgatgagggtgttgagttactaattcatattggattagatactgttgagctaaaaggtcaaggttttattagtcatgtagaagaaggagacagagttttcaaaaatcagttgatttttgaaatggacttgaatttaatcaagactaaaggctacgaaacagttacaccagtaattgtaacgaataccaatgattttctagatgtattagtattacctaataatcagacaatcgagcattctaaggaattactggtaatattataa

SEQ ID NO: 39 - DNA, 246 bp, Streptococcus pneumoniae
atagctggcaagtgggcaatggtcggaatcgccaaatcattttggataaagtcagccaaacgaaccgtcgtttccttgatattaaatttattattgctggcagttacactgataaaatggggagccaactcctgcatatcctgcaaggctgaaataatgttatcattacccacggctgggtttggagggaacacttcaaatgagagtgacggtgtttggcgtgacatatgtaataaccttttctag

SEQ ID NO: 40 - DNA, 669 bp, Streptococcus pneumoniae
gaggttactatggaatctattttagaagttttaaccccagataacctagtctttatctttaaaggatttggcttgaccctctatatttctctgattgccatcatcctctctactatcatcggtacggtgctagctgtcacgagaaatggcaaaaatcctgtcttacgcattatttccagtatttatatcgagtttgtgcgcaacgttcccaaccttctctggatttttactatctttttggtgttcaaaatgaaatccacaccagcaggtattacagcctttactctctttacatcagcagccttggctgagattattcgaggcggtctcaatgccgtagacaagggacagtacgaagcaggaatgtcacaaggcttcacctcagcccaaatcctctactacatcattctcccacaagccatccgcaaaatgctaccagccatcatttctcagtttgttaccgtgattaaggataccagtctcctctactctgttatcgccctacaagaactctttggagccagccaaattctcatgggccgttatttcgaaccagagcaggtcttcagtctttacatcctgattgccctcatctacttcagctttaacctagcaatttctagcctgtctcatatgctagccaaacgttggcaacaagctgcagaataa

SEQ ID NO: 41 - DNA, 768 bp, Streptococcus pneumoniae
agatctctcatggctttagtagaatttaaaaacgtcgaaaaatattacggagactaccacgcattccgcaacatcaatctccgttttgaaaaaggacaagttgttgtcctgcttggaccttctggctctgggaagtccactcttatccgtacgatcaatggtttagagactgttgacaaaggaagtctcctagtcaatgggcaccaagttgctggtgccagccagaaagatttggtacctcttcgcaaggaagtcggcatggtttttcaacattttaacctttatccacacaaagctgtgttagaaaacgtaacgcttgcacccattgaagttctaggaattgataaaaaagaagctgaaaaaaccgcccaaaaatatctggaatttgtaaatatgtgggacaagaaagattcctatcccgccatgctatctggtggacaaaaacagcggatcgccatcgctcgtggtcttgctatgcatccggaactcctcctctttgatgaaccaacatctgctcttgatcctgagactatcggagatgttctagcagttatgcagaaactggcgcatgatgggatgaacatgatcatcgttacccacgaaatgggctttgctcgagaggttgcggaccgcattatctttatggccgacggagaagttttagtagatacgacagatgtcgataacttttttgacaatccaagcgaacctcgtgcccaacaattcctcagcaaaattatcaaccacgaaagtgacaaagtcaaataa

SEQ ID NO: 42 - DNA, 1224 bp, Streptococcus pneumoniae
gaaatgtaccgttatcaaattggcattcccacattagaatatgatcagtttgtcaaagaacatgaattagccaatgtattacaaagtagtgcttgggaggaagttaagtctaattggcaacatgagaagtttggtgtttacagggaagaaaaattactggcgacagctagtattttgattagaactcttccgctaggctataaaatgttttacatcccaagaggacctatattggattatggggataaagaactcttgaattttgccattcagtctattaagtcctatgctcgcagtaagagagcggtttttgtgacttttgacccaagtatttgcctatctcaaagtttaatcaatcaggaaaagacagaatttcctgaaaatctggctattattgatagtttgcaacaaatgggagtaaggtggtcaggaaaaacggaggaaatgggagacaccattcaacctcgtattcaggcgaaaatatacaaggaaaattttgaagaagataaactttccaagtcaacaaaacaggctattcgaacagcacgaaacaaagggcttgagattcaatatggtggactggaactattagattcattttcggagttgatgaaaaaaactgagaagcgaaaagagattcatttgaggaatgaagcctattataaaaaattgttagataattttaaggacaaggcctatatcaccttggccaccttggatgtttctaaacgttcgcaagagttagaagaacagttagcgaaaaatagagccttggaagagacctttactgagtcgactcgaacttcaaaagtagaagcgcagaagaaggaaaaagaacgtttgttagaggaattgaccttcttgcaggaatatatagatgtaggtcaagcgagagttcctttagcggctactttgagtttggaatttggtactacctctgtcaatatatatgctggtatggatgatgattttaaacgttacaatgcaccaattttaacttggtatgaaacggctcgctatgcctttgaacgaggtatgatctggcaaaatttaggtggtgttgaaaactctctcaatggtggactttatcattttaaggaaaaatttaatccaacgattgaagaatacttgggtgaatttacaatgcccactcatcctctctatcctctgttaagacttgctcttgatttccgtaaaacattaagaaaaaaacatagaaagtaa

SEQ ID NO: 43 - DNA, 636 bp, Streptococcus pneumoniae
tgcttttttcagactcctaatcgtggtatactaggtcagtattttataaatatgaaggagatttttatggctaaaaaaggtaccctaacaggtttgctcctgtttggaatattttttggtgcggggaacttgatttttccgccttctctaggtgctctatctggagaacattttcttcctgccatcgcaggttttgtcttttcaggcgttggtatcgccgtcttgacccttattattggaacgctaaatcctaaaggatatatctacgagatttcaacgaagatagcgccttggtttgcgactctttacctctcagttctttacttgtcaatcggtccattctttgctaccccacgtactgctacaacagcttacgaagtagggattagcccccttttgtcggatgcaaataaaggacttggcttgattgtatttacggttctgtattttgcggcagcctatttgatttcgcttaatccatcaaaaatcttagaccgcattggacgtattttaacgccagtctttgcaattttgattgttatcttggtcgttctgggagctatcaaatatggtggaacaagtcctcaagctgcttcactgcttatcaagcttctgcctttggtacaggtttcctag

SEQ ID NO: 44 - DNA, 2049 bp, Streptococcus pneumoniae
tccatcaaaaatcttagaccgcattggacgtattttaacgccagtctttgcaattttgattgttatcttggtcgttctgggagctatcaaatatggtggaacaagtcctcaagctgcttcactgcttatcaagcttctgcctttggtacaggtttcctagaaggttacaataccttggacgcccttgcctcagtggcctttagcgtaatcgcagttcaaaccttgaaacaacttggattttcaagtaagaaagaatacatttcaactatttgggttgttggtatcgttgttgcccttgccttcagcgctctttacatcggtttaggttttcttggaaatcatttcccagtaccagctgaagcgatgaagggtggaacaccaggtgtttacatcttgtcacaagccactcaagaaatctttggctcaacagctcaactcttccttgcagctatggttaccgtaacctgcttcacaacgactgttggtttgattgtgtcaacagctgagttctttaatgagcgcttcccacaaatcagctacaaggtttatgcgacagcctttaccttgattggatttgctattgccaatttgggtcttgatgcgattatcaagtactcaattccagtactggttatcttgtacccaatcacgattgctatcgttatgattgtcattgtcaacaaatttgttgccctttcaaaaccaggtatgcagttgacaattgctgtggttacagttattgccattgcaagcgtactaggaagctcgttaaggttgagtttcttgcaaatcttgttagcgttcttccttttgccaaggcatctctcccatggttggtgccagccattgttggaatcttgctctcattggttctaccaaacaagcaagaaagcgatgtttttgaaatggaataatcacttaaatcacttttgtagccaagtctacaggagtgattttctttttttatccgatgataaatgtgttataataggtagcgaaagaggtgaagaaatgaatcaaacagtagaatatatcaaagaactgacagccattgcgtcgccaacaggctttactcgtgagattgcggactatttagtcaagactctagaaggttttggttaccagccggttcgcacatccaagggcggtgtcaatgtaactattaaaggtcaaaatgatgagcaacatcgctatgtgactgcccatgtagatacgcttggtgctattgtccgtgctgtcaaaccagacggccgtctcaaaatggaccgtatcggtggctttccttggaacatgattgaaggagaaaactgtaccattcatgtggctagcacaggtgaaaaagtatcaggaaccatcctcatccaccaaacttcttgccatgtctataaggatgcaggaactgcagaacgcacgcaagacaatatggaagtgcgtttggacgccaaagtaactagtgaaaaagaaactcgtgctcttggcattgaggtcggtgattttatcagttttgacccacgaactgtcgtgacagagacaggttttatcaagtctcgccatttggatgacaaggtcagtgcggcgattttgctcaatctccttcgcatttataaggaagagaagattgaattgcccgtaacaactcattttgctttttcagtctttgaagaagtgggacacggtgcaaactctaacattcctgctcaggtagtagaatatctggctgtggatatgggagccatgggagatgaccagcaaacagacgaatatacagtgtctatctgtgtcaaggatgcttctggaccttatcactatgacttccgtcaacatttggtggctttggcgaaagagcaagatattccatttaagctggatatctatccattttatggttcggacgcttcagcggctatgtctgcaggggcagaagtcaaacacgcccttctcggtgctggtatagagtctagccattcctatgagcgtacccatattgactcggtgatcgcaacagaacgaatggtcgatgcttatcttaagagcacgttggtggactaa

SEQ ID NO: 45 - DNA, 1032 bp, Streptococcus pneumoniae
aaacacaatgttgctattccttacgatagggagatagatatggcaatgatagaagtggaacatcttcagaaaaattttgtgaagactgttaaggaaccgggcttgaagggggctttgcgctcctttattcatcctgaaaagcagacctttgaagcggtcaaggatttgacctttgaggttccaaaagggcagattttaggatttatcggggcaaatggtgctgggaagtcgacaaccattaaaatgctgacaggaattttgaaaccaacatctggtttttgtcggattaacggcaagattccccaggacaatcggcaagattatgtcaaagatattggcgtagtctttggacaacgcacccagctatggtgggatttggctctgcaagagacctacactgtcttaaaagagatttatgatgtgccagactcgctctttcataagcgtatggactttttgaatgaagtcttggatttgaaggactttatcaaggatcccgtgcggactctttcactgggacaacggatgcgggcggatattgcggcctccttgctccacaatcccaaggttctttttttagatgagccgaccattggtttggacgtttcggttaaggataatattcgtcgggcaattactcagatcaatcaagaggaagaaactaccattcttttgaccactcacgatttgagtgatattgagcaactttgtgatcggattttcatgattgacaaggggcaagagatttttgatggaacggtgagccaactcaaggagacctttggtaagatgaagactctctcttttgaactgctaccaggtcaaagtcatctcgtctctcactatgacggtctgtctgatatgaccattgatagacaaggaaacagcctcaacattgaatttgatagttctcgctaccagtcagctgacattatcaagcaaaccctgtctgattttgaaatccgcgatttgaagatggtggatacggatattgaggatattatccgtcgcttctaccgaaaggagctctag

SEQ ID NO: 46 - DNA, 1509 bp, Streptococcus pneumoniae
cattcatataacatcaaaaagggaggaactgttatggatgcaatctttgacctaatcggaaaggttttcaatcccatcttagaaatgggtggacctgtcatcatgttaatcattttgacagtattggctttactttttggagtgaaattctccaaagcgcttgaaggtggtatcaaacttgccatcgctcttacaggtatcggtgctatcatcggtatgctaaacactgctttctcagcatcactagcaaaattcgttgaaaacactggtatccaattgagtattaccgacgttggttgggcaccacttgctacaatcacttggggttctgcttggacactatacttcttgctcatcatgttgattgtcaacatagtgatgctagctatgaagaaaacagatacacttgatgtcgatatctttgatatctggcacttgtctatcacaggtctcttgattaaatggtatgctgataacaatggtgtgagtcaaggggtttcactctttattgctacagcagctatcgtccttgtcggtgtgttgaaaattatcaactctgacttgatgaaacctacatttgatgaccttcttaacgccccaagttcatcaccaatgacatcaactcacatgaactacatgatgaacccagttatcatggttttggataagatttttgaaaaattcttcccaggccttgataaatatgactttgatgctgctaaattgaacaagaaaatcggtttctggggatctaaattcttcatcggtttcatccttggtatcgttatcggtattatgggaactccacatccaattgcaggtgttgcagatgcagataaatggcgtcttgttatcaaaggatggttgtctcttggtttgactgccggtgtatctttggaactcttctcacttatcggttcatggttcatcgcagccgtagaaccactatcacaaggtattacaaacgttgctactaaacgtcttcaaggacgtaaattcaatatcggtcttgactggccattcatcgctggtcgtgctgaaatctgggcttgtgccaacgtacttgcaccaatcatgttgattgaagcagtgcttctttcaaaagttggaaatggtatcttgccacttgcaggtatcatcgctatgggtgttactccagctctcttggttgtaactcgtggtaaattgctccgtatgattatcttcggaacactcttgttgccactcttccttctttcaggtacacttattgcaccatttgcaacagaacttgctaaaggtgtaggtgccttcccagaaggtgtgagccaaactcaattgattactcactctactcttgaaggaccaatcgaaaaacttcttggttggacaattggtaacactacaactggtgatatcaaagcaatccttggtgcagtagtcttccttgtattctatatcggtatctttgcttggtacagaaaacaaatgatcaaacgtaacgaagagtacgcagcaaaagcaaaataa

SEQ ID NO: 47 - DNA, 366 bp, Streptococcus pneumoniae
tacaatatgggtatgattttaatgaaattagcatctattttattattgatactgaccttagtcgtctgcattatcctaaccaaactttttagattaaaaaaactaggacgaaactttgcggatttggcttttccagtcttggtatttgagtattacttgattacagctaaaacctttacccataatttcctccctagactggggctagccctctcgatcctagccattattctcgtctttttcttccttttgaaaaaacgcagcttttactaccctaaatttatcaaattcttctggcgtgcaggattcttattaacccttatcatgtatatagaaatgattgttgaattgttcttaatgaaatag

SEQ ID NO: 48 - DNA, 729 bp, Streptococcus pneumoniae
aatgataggaggaactttatgggtcatattttcttttttctaagtgtctttttggcagggattctatccttcttttctccttgtatcttacctttgttaccggtctatacaggagtgttactagatgataaggatggtgctcaggcttctagcggcaaattttcaatctcagttactagtttattacgaactctggcctttatagcaggaatttcctttatatttattttgttgggctatggagctggttttttaggcgatttgctttatgcttcttggttccaatatcttactggggcaattattatccttcttggtttgcaccaaatggagattctacactttaaggggctttataaggaaaagaggctacaactgcaaggacaggggcaaaatggtaagggctatagtcaggcatttttattgggcttgacctttagttttgcttggacgccttgcgtggggccggttctggggtctgttttggccttggcggcttcaggtggttcaggagcttggcagggagctggtctcatgttggtgtatacgctgggcttggcgctaccattcttgcttctagctctgacctctagttatgttttgaaacatttccgaaaacttcatccctatctcggaatcctcaaaaaagtgggtggttttctcattattgtgatgggcttcttggttctgtttggaaatgcttcaattttaagtcaattatttgaataa

SEQ ID NO: 49 - DNA, 303 bp, Streptococcus pneumoniae
ttttggacgactagccagtgccgttacatgggcatgaccaatctctctcaaaatagggcgaatcggaacctgaacatgcttgacatgcatgccaattgcagtgtctccgatatccaatccagcatgagccttgataaattcaacctcaactggatcctgcataaacttaaaggctgccaactgccccgaacctcctgcatgaagagtaggatggacactgacaatttccagaccaaactgctctgccacctgacgttcaacaacgagagcccgattgacatgctcacaaccttgaactgctaa

SEQ ID NO: 50 - DNA, 1014 bp, Streptococcus pneumoniae
ttatgggagaaagaaatgaataaacgtctattttcaaaaatgagtctggtgacgttgccaattttagccttgttttcacaatcagttttggcggaagaaaacatccatttttcgagctgtaaggaagcttgggcgaatggctattcggatattcacgagggagaacctggttattctgccaagttagaccgtgatcatgatggtgtggcttgcgaattgaaaaatgctcctaagggtgcttttaaagcaaaacagtcaacggctattcaaatcaacacaagttcagcaacaacaagtggttgggttaagcaggacggcgcttggtactactttgatggaaatggaaatctagtgaaaaatgcatggcagggaagctattacctgaaagctgatggtaaaatggcacagagtgaatggatttatgactcttcttatcaagcttggtattatttgaaatcagatggttcttatgcaaaaaatgcatggcaaggagcttattaccttaaatcaaacggtaaaatggcacaaggtgagtgggtttatgattcttcttaccaagcatggtattacttgaaatcagatggttcatatgctcgcaatgcatggcaaggaaactactatttgaaatcagatggtaaaatggctaaaggtgaatgggtttatgatgccacctatcaagcttggtattatttgacatcagatggttcttatgcttacagtacatggcaaggaaattactatctaaaatcggatggtaaaatggctgtcaatgaatgggttgatggtggacgttattatgttggcgctgacggagtttggaaggaagttcaagcaagtacagcttcttctagtaatgatagcaatagtgaatattctgctgctttaggaaaggcaaaaagttataattcgttattccacatgtcaaaaaaacgtatgtatagacaattaacttctgattttgataaattttcaaatgatgcagctcaatatgccattgatcatttagatgattaa

SEQ ID NO: 51 - DNA, 1239 bp, Streptococcus pneumoniae
atgattgaaacggagaaaaaagaggagcgagtcctgctgattggtgtggaattgcagggtatggacagttttgacctctccatggaagaattggctagtttagcgaaaacggcaggggcagtcgttgtagatagctacagacaaaaacgtgaaaaatatgattccaagaccttcgtcggctctggtaagttggaagagattgcgcttatggtggatgcagaagaaatcactactgtcatcgtcaacaatcgtctgaccccaaggcagaatgtcaatctagaggaagttctcggtgttaaggtcattgaccgtatgcagttgattttggatatctttgccatgcgggctcgaagccatgaagggaagctccaagtccacctagcccaactcaaataccttttgcctcgcttggttggtcaggggattatgctcagccgtcaggcagggggaattggttcccgtggtcctggtgaaagccagctggagctgaaccgtcgtagcgttcgcaatcaaatcacggatatcgagcgccagctcaaggtggttgagaaaaatcgtgcgactgtcagagaaaaacgtttggagtctagcacttttaagattggtttgattggttatactaatgctgggaaatcaactatcatgaacatcttgaccagtaagacccagtatgaagcagatgagctctttgcgactctggatgcgacaaccaagagtattcatctgggaggcaatctccaagtaactttgacagataccgttggctttatccaagatttgccgacagagttggtgtccagtttcaagtcaaccttggaagaaagcaagcatgtggaccttctggttcatgttatcgatgctagcaatccttaccacgaggagcatgaaaaaacggttctctccatcatgaaagacctggacatggaagatattcctcacttgacgctttataataaagcggatttggtggaggatttcacgcctacccaaacgccatataccctcatttctgccaagtctgaggacagtcgtgaaaacttgcaagcattattgctagataagattaaggaaatttttgaagcatttaccctgcgagtgcctttttcaaagtcctacaagattcatgatttagagagtgttgcaattctggaagaacgtgattatcaggaagacggcgaagtgattacaggctacatttccgagaaaaataaatggaggttagaagaattttatgactga

SEQ ID NO: 52 - DNA, 267 bp, Streptococcus pneumoniae
aaagagagaaagatggtctatttagtcctaggaattttactgctcctactctatgtatttgcgacaccagaaagcattaaagggactgtcaatatcgtcgctatggtatgtattttagtggcactcttgattttattggttctatcttttctgaaaatttttcaattaccaacagaaatattcctagcaatagccatgttgatcctagcttactttagtgttagagacatcacactcatgccagtcaaaaaaagtaaaagaagataa

SEQ ID NO: 53 - DNA, 810 bp, Streptococcus pneumoniae
actataaatgaacaaattttaatttcggatgagatagatattgatagtagatattctagaactaaaggttactattcgttattttataatgaagagtataataaaatacagaataaaacagtattagtattaggagcaggagtcttaggatgttatatatctctaagtctaagtatgtatggagtgaggaaacttattgtcgctgattacgatataatagaaccatcaaatttaaataggcaaattctttatacagagtcggatgttggtaaggagaagattaatgttctttctgaaaaaatacacaagtataattcagatgttcaggtagtacctatttctattaaagtttcttcagtagaagaattagaaaaaattgttgcggaatatgggagtatagattttatcgttaaagcaattgatacgcccattgatattataaaaattgtcaatcaatttgctgtatcgcataagatatcctacatatcaggagggtttaatggatgctatcttattattgataatatatatatccctaccatcggttcttgctttggttgtcggaatataaacaaagatataaataagtacactttatctgataagacaaagtggccgactacaccagagatgcctgctattttgggagggataatgactaatttaataattaaaatatttctgggatgttataatgaaatcctaatagataacgcttacgtttataatatgagaaatcatgctctaagtcaagaaaaatatgttctggaaaacggagaatgtccaatttgtaaaaaaataataaagtga

SEQ ID NO: 54 - DNA, 393 bp, Streptococcus pneumoniae
aaaaataataaagtgaaagataacaatattagagcgaaaacatttattcgttcagtttgtttttgcttattatcaggaggagtagcttttttatctgctattgggcagttcactgttatagaaacacaattaatagtattgttcttgggtattatttttgctatatattatgcttactacaataaaaatattcaaacatcattggaaaatatagtatggcttttttcatcgtttgagattttatttttgcttgttaattttagaacatttattcagttaccagtggatatttttattggtatgataatatttttaatgctgtggatatttattatgttaggtatagtgtgtcttagttattatataactttattatttagcaaggaggcttag

SEQ ID NO: 55 - DNA, 750 bp, Streptococcus pneumoniae
atttttggatttttagaaccatctggttctggaaagaccacaacgattaatattctgactgggcagttccttgccgataaaggacaatctattattttgggacaaaaatctcaaaatttaacaagcggtgaattaaagagaattggattggttagcgatacaagtggattttatgagaaaatgtctctgtataacaatcttcttttttatagtaaattttataatattagtaaatcacgtgttgataatttgttaaagcgagtaggattatatgatagtcgcaagatggtagcaggaaaattatccactggaatgaggcaacgaatgcttttagcacgagctcttatcaacaaccccgctgtactctttctggatgaaccgacctcaggtctagatcccacaacttctcgaacaattcatgagttaattttagaattgaaaacagcagggacaacgatttttctaacgactcatgatatgaatgaagcaactcttttatgtgattatgttgccttattaaataaagggaaattagttgagcaaggagctccttctgaactcattcaaagatataataaagataaaaagattaaggttacagattataatgggaatcagataacttttgattttacatcactagaacaggtatctcagactgatctggaaaatattttttcaattcattcatgtgagcctactttagaagatatttttatcacattaacaggaggaaagctaaatgcttaa

SEQ ID NO: 56 - DNA, 777 bp, Streptococcus pneumoniae
ggaggagtaaggatggaatttttcatttgtaatcttgtacgagtcgttcaatcacctcgattttatatgtctttatttttgacccttctttgcatgagtttaggaaatttccttgctttcaatggtatttataaaattgaaggtttatcgattttttttgccgcttcttctattcgaggattttcaccgattagcctagtagctgcacttatctgtacactgccctattctagtcagataatagaggatgctgagagtcattttctaacagcacaattgtgtcgaatttctaaaaagaagtatctggctattgtgggtagtactgtaattatttcttcttttctagtcttttttctcccctatttattattattaggaattaatcttttagtgactccttatcaggaaatttatattggagattatagtggtgccttaaaagaattatttgattccaatcagtttctctatagtcttgtaacgactctctggtatggagtttggggcgctgtgttctctatttttggactagctagtgctttgctagtgaagaaaaaaataggagctattttcatcccagttgcctatatgatggttggtggtattttttgggctattttagggctatcttacttagaacctgtgacaacgctagctttgggatatcagaaagatatcagtctttccttagttagtgctcatcttgcttttattttatttgttagttgtttggttgtttatggtacattttttctacattcagaggactatgtataa

SEQ ID NO: 57 - DNA, 777 bp, Streptococcus pneumoniae
ttatctattttatattttgaatcgagggaatggagatataggacgagatttatttcttcagttgctatttttagtctttctttttcaaagcattttctatttcactcgtcaaaagaggaggtttatagaatgaatgaaataattacattaaaaaatattgagttgaaattaaaaaagacatgtgtttttcaaaaccttaactttagttgtaaacagggggaaattataggaattactggtgcgaatggctcagggaaaagtgtattgtttaaattaatagctggtttatatagtccgtcttatggagaagtgttaatcaatggggaaaatattgttcctgagagaaaaattccagctaatttgggagctttgattgaagaacctggttttataaattattatagtggctttaagaatttacaatatttggcaagcatacgaggagtagttggtaatcaggaaatcaatgatacactgaaaatagttggtctatatgagcaaaaagaccagaaagttaaaacttattcgctaggtatgaggaaaaagctagggattgctcaagcaattatggagaatccctctattcttttactagatgaacctatgaatgccttggataaatcaagtgtagaaaatatgagaacattgtttagaaagctctctagtgaaaaagggacaacaattttgattgctagtcatagtgaagaggatattcgtatcttatgtgataaagtatatgcaatagaagataaagtatgtacactgtgttcagattga

SEQ ID NO: 58 - DNA, 759 bp, Streptococcus pneumoniae
atgtctgaaactatcttagaaatcaaggaactaaaaaaatccttcggagacaatcccatcctccaaggactttctctagaaatcaaaaaaggggaagttgttgtcatcctagggccatctggttgtgggaaaagtaccctccttcgttgcctcaacggcttagaaagtattcaaggtggagatattcttctggatggtcagtctatcgttgaaaataaaaaagattttcacctagttcgccaaaagattggcatggtctttcaaagttatgaactctttccccatctggatgtcttacaaaacctcatcctaggccctatcaaagctcaaggaagggacaagaaagaagtaacggaagaagctttgcaattactagagcgtgtcggtttgctggataaacaacatagctttgcccgtcaattatctggtggacagaagcaacgtgttgcaattgtccgtgccctcctaatgcatccagaaatcatcctttttgacgaggtgactgcttcgctggatccagaaatggtgcgtgaggtgctggaacttatcaatgatttggcccaagaaggccgtaccatgattttagtaacccacgaaatgcagtttgcccaagccattactgaccggattatcttcctcgaccaagggaaaatcgctgaagaaggaacagctcaagccttctttaccaatccgcaaaccaaacgagcccaggaatttttaaacgtctttgactttagccaattcggctcatatctataa

SEQ ID NO: 59 - DNA, 672 bp, Streptococcus pneumoniae
tccattgttgaacaatatctaccactatatcaaaaggcattctttctgaccttgcatattgcagtttggggaattttgggatcctttctgctcggtttaatcgttagtatcatccgacattatcgaatccttgttttggcgcaagtagcgacagcctacattgaattgtcacgtaatacgccccttttgattcaactcttctttctctacttcggtcttccccgaatcgggattgtcctatcttcagaagtctgtgcaacgcttgggcttgtctttttaggaggctcctatatggcagaatctttccgaagtgggctggaagccatcagtcaaacccagcaggagattggcctcgctattggtctgacacctctacaggtcttttactatgtggttcttccgcaagcaacagcggtggcactcccctcctttagtgccaatgtcattttccttatcaaggaaacctctgttttctcagcagtggctttggccgacctcatgtacgtcgccaaggatttgattggtctctactatgagacagacattgcgctagctatgttggtagttgcttatctaatcatgctgctacccatctcactggtctttagctggatagaaaggaggctccgccatgcaggattcgggaatccaagtactctttcaaggaaataa

SEQ ID NO: 60 - DNA, 1386 bp, Streptococcus pneumoniae
atgggtctggaactacgagcgattcagtccccaatcttctctgagccgtttgattttacttttcatgcgcaagcctttaccttgttagttgggagtagtgggtctggaaaatccagcctctttcaaatgattgcccaagttagttctcttccctatagcggtcaagtcctgatagatgggagcgaggtcagtcagctttctatcgtcgaacgtgtccagacggttggtattctcttgcaaaatcctaatcatcaatttaccatggagagcttgtttgaggagttggtttttaccatggaaaatatcggctatcaccttcaggaaattgattctaaaatagcagaggttgtccagcaatgtcgttgcaaggacatcttgcaccgtctcatccatcacttatcaggtggggaaaagcaaaaagcagcgctggctgtcctctttgccatgaatcctagggtctatctcttggatgagcccttcgcttccattgaccgcaagagcagaatcgagatattggagattctaaaagagttggtctatgatgggaagacagttattttgtgcgaccatgatttatctgactataaagcctatatcgaccatatggtggagctaagagacggaaaactaagggaagtgtttcaaatcccttcctatgagatgacacaggttgcttcaaaggaagttgcttctagcccggaactattccatatgaaccgtgtgactggtgagcttggtaatcgccccctcttttcaattgctgatttcacattctatcaagggatttcctgtatcctgggtgacaatggtgtcgggaaatcaaccctctttcggtctattcttcaatttcaaaagtataaggggagcattacttggaagggttcggtcctgaaaaagaaaaagagtttgtatcgtgatctgactggtgttgttcaggaagctgagaagcagtttatccgagtcagtctgcgagaggagcttcaattagatggacctgattctgaaagaaatcagcggatttttcaagctttacgatattttgatttggagcaggcagtcgataagagtccctatcaattaagtggtggtcagcaaaaaattcttcagctcctgaccatcttgaccagtaaggcttccgtgatcttgctagatgaaccttttgcaggtttggatgatagagcctgccattatttttgcaagtggattgtggaggagaggaatcaaggaagaagttttctgctcattagtcatcgtttagaccctttgatttctgtggttgattattggattgagatgactagtcagggtcttcggcatgtgaaagaagtgaccattaccaaaccacttacatctcagagtagcaatacccaaggggaggtgagatag

SEQ ID NO: 61 - DNA, 1212 bp, Streptococcus pneumoniae
ccatcatctcttgtttttttgtggtacaatagagctatgaaacattttgatactattgtcatcggtgggggacctgctggtatgatggctacgatttccagtagcttttatggacagaaaaccctcctcatcgaaaaaaatcggaaacttggaaaaaaattagctgggactggtgggggacgttgcaatgtgaccaacaatggtagcttagacaacctgctagctggaattcctggaaacggacgctttctttacagtgttttctcccagttcgataatcatgacatcatcaacttttttacagaaaatggtgttaaacttaaggtcgaagaccacggacgcgtctttccagccagtgacaagtctcggactattatcgaagctttggaaaagaaaatcaccgaactaggtggtcaagttgctactcaaatagaaatcgtttctgttaaaaaagtagatgaccagtttgtccttaagtcagcggatcaaaccttcacttgtgagaaactcattgtcacaacaggtggtaagtcttatccttcgactggttcgactggttttggtcacgagattgctcgccattttaagcataccatcaccgatcttgaggctgctgaaagtcctttattaacagattttccacataaagccttacaaggtatttctctggacgatgtgaccctaagttatggtaagcatgtcatcactcatgatttactctttacccactttggtttgtcaggtcctgctgccctacgcatgtctagctttgtcaaaggtggggaggttctctcactcgatgttttgcctcaactttctgagaaggacttggttacatttctagaagaaaatcgggaaaaatccttgaaaaacgctttaaaaaccttgttaccagaacgcttggccgaattttttgtacaaggatatcctgaaaaagtcaaacaactgactgaaaaggaacgagaacaacttgtccagtccattaaagaacttaaaattcctgtaactggaaaaatgtcccttgcaaagtcctttgttaccaagggtggagtcagtctcaaggaaatcaatcctaaaacccttgaaagtaagctggtacctggcctccactttgcaggcgaagttatggatatcaatgcccacacgggtggctttaacatcacttctgccctctgtaccggctgggtggcgggaagtctgcattatgattaa

SEQ ID NO: 62 - DNA, 264 bp, Streptococcus pneumoniae
ggagacaaaaagatgaagaaaaaatttgccctatcgtttgtggcgcttgcaagtgtagcacttcttgcagcctgtggagaagtgaagtctggagcagtcaacactgctggtaactcagtagaggaaaagacaattaaaatcgggtttaactttgaagaatcaggttctttagctgcatacggaacagctgaacaaaaaggtgcccaattggctgttgatgaaatcaatgccgcagtggtatcgatggaaaacaaatcgaagtag

SEQ ID NO: 63 - DNA, 783 bp, Streptococcus pneumoniae
gaaggaggaacaaaactaatggcattacttgaagtaaaacagttaaccaaacattttggtggtctaacagctgttggagatgtgactcttgaattgaacgaaggggaactggttggattaatcggtccaaacggagctgggaaaaccacccttttcaaccttttgaccggtgtttatgaaccaagcgagggaacagtaaccctagatggtcaccttttgaatgggaaatcaccttataagattgcctctttgggacttggacgtactttccaaaatatccgtctctttaaagatttaacagttttagataatgttttgattgcttttggaaaccatcacaaacagcatgtttttactagtttcttacgcttaccagctttttacaagagtgaaaaagaattaaaggctaaagctttggaattgttgaaaatctttgatttagatggtgatgcagagactcttgctaaaaatctttcctacggacaacaacgtcgtttggaaattgttcgtgcccttgctacggaacctaaaattctcttcttagatgaaccagcagcaggtatgaacccacaggaaacagccgaattgactgagttaattcgtcgtatcaaagatgagtttaagattacaatcatgttgattgaacacgatatgaatctggtcatggaagtaacagaacgtatctacgtacttgaatatggccgtttaatcgctcaaggaactccagacgaaattaagaccaataaacgcgttatcgaagcttatctaggaggtgaagcctaa

SEQ ID NO: 64 - DNA, 705 bp, Streptococcus pneumoniae
aaaggaactcacatgtcaattattgaaatgagagatgtcgttaaaaaatacgacaacggaacaactgctctacgcggtgtttcggttagcgttcaaccgggggaatttgcttacatcgtaggaccttcaggagcagggaagtcaacttttattcgttctctgtatcgtgaagtaaaaatcgataaaggaagcctatcagttgctggttttaatctggttaagatcaaaaagaaagatgtcccgcttctacgtcgtagtgttggggttgtcttccaggattataaattgttaccaaagaaaactgtctatgaaaatattgcttacgctatggaagtaatcggggaaaatcgccgtaatatcaaaagacgagtgatggaagttttggacttggttggattgaagcataaggttcgttctttcccaaatgaactctcaggtggggagcaacagcggattgcgattgcgcgtgcaattgtaaataatcccaaagtattgatagctgatgagccaacaggaaatctggatccggataattcatgggaaattatgaatctcttggaacggattaacctacaaggaacaactattttgatggcgactcataatagccagattgtaaataccttgcgccaccgtgtcattgccattgaaaatggccgtgtcgttcgtgacgaatcaaaaggagagtatggatacgatgattag

SEQ ID NO: 65 - DNA, 2181 bp, Streptococcus pneumoniae
atgatgaaagatacattcaaaaatgtcttgtctttcgaattttggcaaaaattcggtaaggctttgatggtagttatcgcggttatgccggctgctggtttgatgatttcaatcggtaagtctatcgtgatgattaacccaacctttgcaccacttgtcatcacaggtggaattcttgagcaaatcggttggggggttatcggtaaccttcacattttgtttgccctagccattggaggaagctgggctaaagaacgtgctggtggtgctttcgccgctggtcttgccttcatcttgattaaccgtatcactggtacaatctttggtgtatcaggcgatatgttgaaaaatccagatgctatggtaactactttctttggtggttcaatcaaagttgctgattactttatcagtgttcttgaagctccagccttgaacatgggggtattcgtagggattatctcaggttttgtaggggcaactgcttacaacaaatactacaacttccgtaaacttcctgatgcactttcattcttcaacgggaaacgtttcgtaccatttgtagttattcttcgttcagcaatcgctgcaattctacttgctgctttctggccagtagttcaaacaggtatcaataacttcggtatctggattgccaactcacaagaaactgctccaattcttgcaccattcttgtatggtactttggaacgtttgctcttgccatttggtcttcaccacatgttgactatcccaatgaactacacagctcttggtggtacttatgacattttaactggtgcagctaaaggtactcaagtattcggtcaagacccactatggcttgcatgggtaacagaccttgtaaaccttaaaggtactgatgctagtcaatatcaacacttgttagatacagtacatccagctcgtttcaaagttggacaaatgatcggttcattcggtatcttgatgggtgtgattgttgctatctaccgtaatgttgatgctgacaagaaacataaatacaaaggtatgatgattgcaacagctcttgcaacattcttgacaggggttactgaaccaatcgaatacatgttcatgttcatcgcaacacctatgtatcttgtttactcacttgttcaaggtgctgccttcgctatggctgacgtcgtaaacctacgtatgcactcattcggttcaatcgagttcttgactcgtacacctattgcaatcagtgctggtattggtatggatatcgttaacttcgtttgggtaactgttctctttgctgtaatcatgtactttatcgcaaacttcatgattcaaaaattcaactacgcaactccagggcgcaacggaaactacgaaactgctgaaggttcagaagaaaccagcagcgaagtgaaagttgcagcaggctctcaagctgtaaacattatcaaccttcttggtggacgtgtaaacatcgttgatgttgatgcatgtatgactcgtcttcgtgtaactgttaaagatgcagataaagtaggaaatgcagagcaatggaaagcagaaggagctatgggtcttgtcatgaaaggacaaggggttcaagctatctacggtccaaaagctgacattttgaaatctgatatccaagatatccttgattcaggtgaaatcattcctgaaactcttccaagccaaatgactgaagcacaacaaaacactgttcacttcaaagatcttactgaggaagtttactcagtagcagacggtcaagttgttgctttggaacaagtaaaggatccagtatttgctcaaaaaatgatgggtgatggatttgcagtagaacctgcaaatggaaacattgtatctccagtttcaggtactgtgtcaagcatcttcccaacaaaacatgcttttggtattgtgacggaagcaggtcttgaagtattggttcacattggtttggacacagtaagtcttgaaggtaaaccatttacagttcatgttgctgaaggacaaaaagttgcagcaggagatctccttgtcacagctgacttggatgctatccgtgcagcaggacgtgaaacttcaacagtagttgtcttcacaaatggtgatgcaattaaatcagttaagttagaaaaaacaggttctcttgcagctaaaacagcagttgctaaagtagaattgtaa

SEQ ID NO: 66 - DNA, 1551 bp, Streptococcus pneumoniae
ggaattaaaatgagtattttagaagttaaaaatctgagtcacggttttggtgaccgtgcaatttttgaagatgtgtccttccgtctcctcaagggagaacatatcggcctggtcggtgccaatggtgaaggaaaatcaacctttatgagtatcgtgactggtaaaatgctgccagatgaaggaaaggttgagtggtccaaatatgtgacggctggttacttggatcagcactctgtccttgctgaaagacagtcggtgcgtgatgttctccgtacggcttttgatgagcttttcaaagctgaagctcgtatcaatgacctctatatgaaaatggctgaagacggcgcggatgttgatgctctcatggaagaagtaggagaacttcaagaccgtctggagagtcgtgatttctataccttggatgctaagattgacgaagtagcgcgtgctcttggtgttatggactttggcatggatacggatgtaacttctttgtcaggtgggcaaagaaccaaggtgcttttggcaaaacttctccttgaaaagcctgatatcttgctgttggacgagccgaccaactacttggatgctgagcatattgattggctcaagcgctatctccaaaactatgagaatgcctttgttctcatttcgcacgatattccattcctcaatgacgttattaatattgtctatcatgtggaaaatcaacagctgacgcgttactctggtgactactaccagttccaagaagtttatgctatgaagaaatctcagctagaggcagcctacgaacgccagcagaaagagattgcagacctcaaggactttgtggctcgtaataaagcccgtgttgcaactcgtaatatggctatgtctcgtcaaaagaaattggataagatggatattatcgaactccaaagtgagaaaccaaaaccatcctttgatttcaaaccagctcgtacaccagggcgctttatcttccaagccaagaacttgcaaattggttacgaccgtcctcttactaagcctttaaatcttaccttcgaacgcaatcaaaaggttgcgattattggtgctaatggtattggaaaaacaactctcttgaagagtctcttgggcattatctcgccaatcgctggggaagtggagcgtggagattatttagaacttggttattttgagcaggaagtagaaggcggtaatcgccaaactcctcttgaagctgtctggaatgcctttcctgcccttaatcaagcagaagtccgtgcagcccttgcccgttgtggtttgacaaccaaacatattgaaagccagattcaagtattatcagggggagagcaagccaaggttcgtttctgtctcttgatgaatcgtgaaaacaacgttttagtgctggacgagccgaccaaccatttggatgtggatgcaaaggatgagctcaaacgcgctctcaaagaatataggggatctatccttatggtctgccacgagccagacttttatgaaggctggatagaccaaatatgggattttaataatttaacttaa

SEQ ID NO: 67 - DNA, 822 bp, Streptococcus pneumoniae
atttttgagaggatcagaatgaaaaaactagcaacccttcttttactgtctactgtagccctagctgggtgtagcagcgtccaacgcagtctgcgtggtgatgattatgttgattccagtcttgctgctgaagaaagttccaaagtagctgcccaatctgccaaggagttaaacgatgctttaacaaacgaaaacgccaatttcccacaactatctaaggaagttgctgaagatgaagccgaagtgattttccacacaagccaaggtgatattcgcattaaactcttccctaaactcgctcctctagcggttgaaaatttcctcactcacgccaaagaaggctactataacggtattaccttccaccgtgtcatcgatggctttatggtccaaactggagatccaaaaggggacggtacaggtggtcagtccatctggcatgacaaggataagactaaagacaaaggaactggtttcaagaacgagattactccttatttgtataacatccgtggtgctcttgctatggctaatactggtcaaccaaacaccaatggcagccagttcttcatcaaccaaaactctacagatacctcttctaaactccctacaagcaagtatccacagaaaattattgaagcctacaaagaaggtggaaaccctagtctagatggcaaacacccagtctttggtcaagtgattgacggtatggatgttgtggataagattgctaaggccgaaaaagatgaaaaagacaagccaactactgctatcacaatcgacagcatcgaagtggtgaaagactacgattttaaatcttaa

SEQ ID NO: 68 - DNA, 1368 bp, Streptococcus pneumoniae
aagattacaaaggagttttcaatgagagaatatgatatcattgctatcggtggaggtagcggaggaatcgctaccatgaaccgtgctggtgaacatggagccaaagcagccgttattgaggaaaagaaattaggtggaacctgtgtcaacgtcggttgtgttcctaaaaaaatcatgtggtacggggcgcaaatcgctgagactttccatcaatttggagaagactacggctttaagactactgatcttaactttgactttgcaaccctacgtcgcaatcgtgaagcctacattgatcgcgctcgttcttcttatgatggtagttttaaacgcaacggtgtagacttgattgaaggtcatgctgaatttgtagattctcatactgtaagcgtaaatggtgaactgattcgtgctaaacatatcgtgattgctacaggtgcccatccaagtattcctaatattcctggtgctgagctaggtggctcttctgatgatgtatttgcctgggaagaacttccagagtcaattgccattctaggcgctggttatatcgccgttgaattagctggcgtactccacacttttggtgtcaagacagatctctttgttcgccgcgatcgtcctttacgtggttttgattcctacatcgttgaaggtttggtcaaggaaatggaaagaacaaacttaccacttcacactcacaaagtccctgtcaagttagaaaaaactactgacggcattaccattcatttcgaagatggtactagtcacacagctagccaagttatctgggctacaggtcgccgtccaaacgttaagggcttgcaacttgaaaaagctggagtgactctgaacgaacgtggctttatccaagtggatgaataccaaaatactgttgttgagggaatctatgctctaggtgatgtaacgggcgagaaagaactgactccagttgcaatcaaggccggacgtaccctatctgaacgtctctttaacggaaaaactactgcaaaaatggattactcaactattccaactgttgtcttttcacaccctgctatcggaactgttggtttgacagaagagcaagctattaaagaatacggtcaagaccaaatcaaggtttataaatcaagctttgcatctatgtactctgcttgcacttgcaaccgtcaagaatcccgtttcaaactcataacagctggttcagaagaaaaagttgtcggacttcatggaattggctacggcgttgatgaaatgattcagggatttgccgttgctatcaaaatgggagcaaccaaggctgactttgatgcaactgtggcaattcacccaactgcatctgaagaatttgtaaccatgcgttaa

SEQ ID NO: 69 - DNA, 1338 bp, Streptococcus pneumoniae
aagatgttcagtaaacttaaaaaaacatggtatgcggatgactttagttattttatccgcaacttcggtgtcttcaccctgattttttctacaatgactctgattattttacaagtcatgcattcgagtctttatacttcggtggacgataagcttcatggactgagtgaaaatcctcaagcagttattcagctggctataaatagggcaacagaagagattaaagatttagaaaatgctagggcggacgctagtaaagtagaaataaaacctaatgtcagttccaatacggaagtcattctctttgataaagactttactcaacttctttctggaaatcgatttttgggcttggataagattaagttagaaaagaaagaactaggacatatctaccagattcaggtttttaatagctatgggcaggaagaaatctatcgtgtgattttgatggagaccaatattagttcggtttcaaccaatatcaagtatgctgctgtcttgattaataccagtcagttggaacaggctagtcaaaagcatgagcaattgattgtggtcgtgatggctagtttctggattttgtctttacttgccagtctctatctagctagggtcagtgttaggcccctgcttgagagtatgcagaagcaacagtcttttgtggaaaatgccagtcatgagttacgaactccactcgcagttttgcaaaatcgcttagagaccctttttcgtaagccagaagctaccattatggatgtgagcgaaagcattgcatcgagtttggaagaagtccgaaatatgcgttttttaacgacaagcttgctgaacttagctcggagagatgatgggattaagccggagcttgcagaagttccaactagcttttttaatacaactttcacaaactacgagatgattgcttcggaaaataatcgtgtcttccgttttgaaaatcgtatccatcgaacaattgtcacagatcagcttcttctgaaacaactgatgaccattcttttcgataatgccgtcaagtatactgaggaggatggtgaaattgattttcttatctcggcgaccgatcgcaatctttatttacttgtttctgataatggaatcggtatttcgacagaagataaaaagaaaatttttgaccgtttttatcgagtagacaaggctagaacccggcaaaaaggtggttttggtttaggattatccctagccaagcaaattgtagatgctctaaaaggaactgttactgtcaaagataataaacccaagggaacaatctttgaagtgaagattgccattcagacaccatctaaaaagaaaaaataa

SEQ ID NO: 70 - DNA, 1092 bp, Streptococcus pneumoniae
gattgtaattttcttacgggcatgattctctccttaacagtacatacctattttatcattttttcggcagagaattattacagaaaggttacaaaaagaataaagtcccttttcattttcaaagcatggctgattttggagaaatgtggtataatttttcttatggaaaagattgtcattacagcaactgctgaaagtattgaacaagttgaacaactactcgaagctggcgtagaccgtatctatgtcggtgagaaagattttggtcttcgtctgccaacgacctttagttatgaccaattacgtgaaatcgctaagttggttcatgatgctggtaaggaattgatcgttgcggtcaatgctctcatgcaccaagatatgatggaccgtatcaagcctttcttaaacttcttggaagaaatcaagacagactatattacgattggggatgcaggcgtcttttacgtagttaaccgcgatggttattcatttaagaccatctacgatgcttcaaccatggtaactagcagtcgtcagattaacttctggggacaaaaggctggcgcatctgaggctgttttggcgcgtgaaattccatcagctgaacttttcaaaatgccagagattttggaaattcctgctgaagttttggtttacggtgctagcgtcatccatcattctaaacgtccactcttgcaaaactactataactttacacatatcgatgatgaaaagacgcataaacgtgacctcttcttggctgagccaagtgatccagagagccactattccatttttgaagataatcatgggacccatatctttgccaacaatgaccttgatttgatgatcaaattaacagaattggtggagcatggctttactcgctggaaactagaagggctctacactcctggtcagaactttgttgagattgcaaaactctttatccaagcgcgtagcttgattcaagagggcaactttagtcatgctcaagccttcttgctggatgaagaagttcgtaaacttcaccctaaaaaccgtttccttgatacaggattttatgactacgatcctgacatggttagataa

SEQ ID NO: 71 - DNA, 765 bp, Streptococcus pneumoniae
ataaattggataaaaaatttaaattttaattcaaaacatgttataatcatacagtattctattttagaaagcagtgtgactatgaatttttcttttttacctaagtatttaccttattttaactatggggctgttgtgacgattcttatttctatctgtgttatctttttgggaactattttgggtgttgtcttggcttttgggcaacgttcaaagtttaaaccgcttgtttggttggccaacttgtacgtttggattttccgtgggacaccgatgatggttcaaattatgattgcctttgctcttatgcatatcaatgctccgactattcagattggaattttaggtgttgatttttcgcgtctgattccagggattttgattatctctatgaatagtggtgcttatgtttcggagactgttcgtgccggaatcaatgcggttccaaaaggtcagctagaagcggcttattcgctagggattcgtcctaaaaatgcgatgcgttatgtgattttgccacaagcagtcaaaaatatcttgccagcattggggaacgaatttatcaccattatcaaggacagctccctcttatcagctattggggtcatggagttgtggaatggggctacaacagtttctacaacaacctatctacctttaacaccacttttatttgcagcattttactacttgattatgacctctattctgacagtagccttgaaagcttttgaaaaacatatgggacaaggagataagaaataa

SEQ ID NO: 72 - DNA, 741 bp, Streptococcus pneumoniae
gaaataatgacagaaaccttgataaaaattgaaaatttacataaatcctttggaaagaatgaagtattgaagggcatcaacctcgagattaaaagaggagaagttgtcgttatcatcggtccttcagggagcgggaaatctaccttgcttcgctctatgaatttgttggaagaagcaaccaaggggaaggttatctttgagggagtcgatattacggacaagaagaatgacctgtttgccatgcgtgagaagatgggcatggtttttcaacaattcaatctctttcctaatatgactgtgatggaaaatatcaccttgtcccctatcaagaccaaaggtgacagtaaggccgttgcagagaaaagagctcaggaacttttggaaaaagttggtttgccagataaggcagacgcttatccacagagtttgtcaggtggccagcaacagcggattgccatcgcgcgtgggttggctatggaaccagatgttttgctctttgacgagccaacttcagccctagatcctgagatggttggagaagttctggctgttatgcaagatctagccaagtcaggaatgaccatggttatcgtaacacatgagatgggatttgcccgtgaggtggcagatcgtgtcatctttatggcagacggtgtggttgttgaagacggaacacctgagcagatttttgaacaaacccaaggacaaaggactaaagacttcttgagtaaggttttataa

SEQ ID NO: 73 - DNA, 261 bp, Streptococcus pneumoniae
ttcacaacttataggaggtgtactatgaaaatcttaaaacgttacatattggaactctgttttattttaagttttgctttaccttttataaaaggaaccaatgcagataatggtagatgctttgtggaaacctattacggttttacttttttgatggaacatgctattgtaacagctgtctttatttgttcgttcttaattgctttcttactaaaaaacgatggacgaaatggattgctgcgggtagttattgctttttag

SEQ ID NO: 74 - DNA, 1548 bp, Streptococcus pneumoniae
aaggaagagcacatggcacacgaaaatgtcattgagatgcgtgatattaccaaggtgtttggtggatttgttgccaacgacaaaatcaacttgcacctacgaaaaggtgaaattcatgcacttttaggagaaaatggggctggtaagtccacgctaatgaacatgttagcaggccttcttgaaccaactagtggtgaaatcgcggtcaacggtcaagttgtcaatctcgactccccatctaaagcagctagcttgggaatcgggatggttcaccagcactttatgttggttgaagccttcacagtggctgaaaacatcattttaggtagtgaattgactaaaaatggtgtgctagatatcgctggagctagcaaagaaatcaaggctctttctgaacgttatggcttagctgttgacccttctgccaaggtagcagatatctcagttggagcccaacaacgtgtagaaattttaaaaacactttatcggggggctgatatccttatctttgacgaaccaacggctgttttgactccatcagaaattgatgagttgatggctattatgaaaaatcttgtcaaagaaggaaaatcaattatcttgattacccacaaattggatgaaattcgagcagtttctgaccgtgttacagttatccgtcgtgggaaatcaattgaaaccgttgaaattgcaggggctaccaatgctgatttggcggaaatgatggtaggacgttctgtttcctttaaaacagagaagcaagcctctaaaccaaaagaagtggttttgtctatcaaagatttggtggtcaatgaaaaccgtggtgttccagctgttaaaaatctgtccttggatgttcgtgctggagagattgttggtattgcggggattgatggaaatggtcagtctgaactgattcaagccattacaggtcttcgtaaggttgaatctggtagcattgagctaaaaggagattcaattgtaggcttgcacccacgtcagattacagaactaagtgttgggcacgttccagaagaccgtcaccgtgatggcttgattttggaaatgatgatatctgaaaatattgcccttcaaacctactataaagaaccacatagtaaaaatggaattttgaattattcaaatattacttcttatgctaaaaagctgatggaagagtttgatgttcgcgctgccagtgaattagttcctgcagctgcactctcaggaggaaatcaacaaaaagcaattattgctcgtgaaattgatcgagatcctgatctccttatcgttagccagccaactcgtgggttggatgtcggtgccattgagtatatccacaaacgcttgattgaagagcgtgataatggcaaggctgtccttgttgtcagctttgaattggatgagattttaaacgtctcagaccgtattgccgttatccacgatggtaagattcaaggtattgtatcaccagaaacaaccaataaacaagaacttggtgtcttgatggctggtggaaacttgggaaaggagaagagtgatgtctaa

SEQ ID NO: 75 - DNA, 939 bp, Streptococcus pneumoniae
gggaggagaacaaaaatgacagagttggcaaagcaactattagagttgacctatattgtgattggttgtcaatttctccatacagcctattgtagttataaagataaaacaaacccagttcgacttgggacatctgcattttggactctattgtctattacgtttataggtggttcctatatgccaaatatgagtattggtattattgtaatcctattatcgctgttaacattgtttaagcaagtccgtatcggaaccttgccatccttagatgaaatgaaagccaatattgaatctaacaggttgaaaaataaaatttttattccagttatgctgatggcaatacttgcgttggtcttagcgcaaatgattccagaatttagcaagatttcgattagccttgccgccttgtttgctacaatttctgttcttgtgattaccaatagtcaccctaagagtctgttatcagaaaataatcgaatgactcagcaagtttcaacaagtgggattgttcctcaattattaggggctttgggggctatttttactgtagcaggtgttggtgatgttatctctcatctgattagcggtattgttccttcagatagtcgctttataggagttttggcctatgttcttggaatggttctattcacaatgattatgggaaatgcttttgcagcattcaccgttattacagcaggtgttggagttccctttgtatttgctctgggagctaatccaattgtggctggtgctcttgccatgacagcaggttattgtgggaccttattgaccccaatggctgctaattttaacgctctaccagcagcattgatggatatgaaagatcagaatggcgttataaaggctcaagcaggtgttgctctagtaatgattgttattcacatattcttaatgtactttctcgcattttag

SEQ ID NO: 76 - DNA, 1113 bp, Streptococcus pneumoniae
ctcatgtttcgtagaaataaattatttttttggaccacagaaattttactcttaaccatcatcttttacctatggagacagatggggtctttgattaacccttttgttagcgtgcttaatacaattatgattccatttttattagggggctttttttattatttgacaaaccctattgttactttcttaaataaagtctgtaaactcaatcgtttgcttggtattttaattaccttgtgtactttggtctggggaatggtcataggtgttgtctatctcttacctattttgattaatcagttatctagtttgattatatctagtcaaactatttatagtcgagtacaagacttaatcatagacttatctaattatcctgcgctccagaatttggatgtagaagctacaattcagcagttaaacttatcctatgttgatattcttcaaaatatcctaaatagcgtatcaaatagtgtggggagcgtcttgtcagctcttatcagtactgttttgattttgattatgactccagtttttttggtttatttcttattagatggacataaattcttgcccatgcttgaaagaacgattctaaagagggatcgcttgcatattgcaggcttattaaagaatttaaatgcgacgattgctcgctatattagtggagtttcgattgacgcaatcattataggttgtttggcttatattggctatagtattattggtttaaaatatgctttagtttttgccattttttctggtgtagccaatttaattccttatgtggggccaagtattggtttgattcctatgatcatcgcaaatatattcactgatccccatagactgctgattgcagtgatttatatgcttgttgttcagcaggtagatggcaatatcttatatcctcgaatcgtaggaagtgttatgaaggttcatccaatcacgattttagttttacttttgttgtcaagcaatatctatggtgtagttggaatgattgtcgcagtgccaacctattctatcttgaaagaaatttctaagttcttatcccatttgtatgaaaatcataaaataatgaaagaacgagaaagagaattagctaagtaa

SEQ ID NO: 77 - DNA, 1995 bp, Streptococcus pneumoniae
attagtatgtttcgattaaccaataagttagcggtatcgaacttgattaaaaaccgcaaactctactatccctttgcactggctgttctcttggcagtcaccatcacctatctcttttactccctaaccttcaatccaaagattgcggaaatccgtggaggaaccaccattcaagcaacacttggatttggtatgtttgtcgttacccttgcgtcagccattatcgtcctctatgccaatagttttgtcatgaaaaaccgttccaaggaactgggtatatatggcatgttaggcttggagaagcgccatctaatcagtatgacctttaaggagttagtggtatttgggattctaactgttggagcgggtatcggtattggagccttgtttgacaagttaattttcgctttcctgctcaaactaatgaaactgaaggttgagctggttgctaccttccaaatgaatgttgtcattgcagtacttgttgtctttggattgattttcctaggcctcatgttcctgaatgctcttcgaatcgcccgtatgaatgccctccagctctcgcgtgagaaagcaagcggagagaaaagaggtcgcttcctacctctccaaacgattcttggttccataagtttagggattggctattatcttgcccttacggtaaccgatcctcttacagccctaacaactttcttcctagctgttttgctggttatctttggtacttatctattgtttaatgcagggattacagtcttcctacaaatcttaaagaaaaacaagaaatactattaccaacctaataacctcatatctgtttccaacttgattttccgtatgaagaaaaatgcggttggactagcaaccatcgctattttgtcaacaatggttttggtaaccatgtcagcagcgacaagcattttcaattccgcagaaagctttaaaaaagttctaaatcctcatgattttggggtttcagggcaaaatgttgaaaaagaagatttggacaaactcttgagccagtttgcaagtgacaaaggttatagtgtcaaagagaaagaagtacttcgttacagtaactttggtattgcaaatcaagaaggaaccaagttaactatttttgaaaaaggacaaaaccgtgtccaacccacaacagttttcatggtatttgaccaaaaagattatgaaaatatgactggtcaaaaactgtctctatcaggaaatgaggtcggtctctttgccaaaaatgacggactgaaaggacagaaagctctaactctaaatgatcatcaattttctgtcaaagaagaatttaataaagatttcattgtgaaccatgttccaaataagtttaatatcttgactactgattacaattaccttgttgttcctgatttacaagcctttttggatcaattcccagattcggctatctataatcagttttacggtggtatgaatgtaaatgtcagtgaagaagaacaactcaaggtcgctgaggagtatgaaaactacctcaatcaatttaatgctcaattagacacagaaggtagctatgtttatggtagcaatctagcagatgctagttctcagatgagtgccctctttggtggtgtcttctttatcggtattttcctatccattatctttatggtcggaactgttctggtcatctactacaaacaaatttctgaaggctacgaagaccgtgaacgctttattatcttgcagaaagtcggtttggaccaaaagcaaatcaagcaaaccatcaacaaacaggttttaactgttttcttccttcctttgctctttgccttcatacatctcgcctttgcctaccatatgcttagcctgattttaaaagtgattggtgtactggatacgactatgatgttgattgtgaccttgtctatctgcgctatcttcctcatcgcctatgtgctgattttcatgattacttcaagaagttatcgcaagattgtgcaaatgtaa

SEQ ID NO: 78 - DNA, 1290 bp, Streptococcus pneumoniae
ggacattttagaagaagaggaaggaaaaaaatgagtcgtttactagttattggttgtgggggcgttgcccaagttgctatttcaaagatttgtcaagatagcgaaacatttacagagattatgattgctagccgtaccaagtcaaaatgcgatgacttgaaagcgaagctagaaggcaaaacaagtactaaaattgaaactgcagcacttgatgctgacaaggttgaagaagtgattgccctgattgaaagctacaaaccagaagctgttttgaatgtagctctgccttatcaagatttaaccattatggatgcttgtttggcaacaggtgttcactatatcgatacagccaactacgaagcagaagacacagaagaccctgagtggcgtgctatctacgaaaaacgttgtaaggaacttggttttacagcctactttgactactcatggcagtgggcttatcaagagaaattcaaagaagcaggcttgactgctcttcttggttctggttttgacccaggtgtaactagtgtcttttcagcttatgccctcaaacactattttgatgaaatccattatatcgacattttagactgtaatggcggtgaccacggttatccatttgcaaccaactttaatccagaaattaatctccgtgaggtttctgcgccaggttcttactgggaagatgggaaatgggtcgaagtcgaagctatgtctatcaagcgtgagtatgatttccctcaagttggacaaaaagatatgtatctccttcaccatgaagaaatcgaatcattggccaagaacattccaggtgtcaaacgcattcgtttctttatgacttttggtcaatcttacttgacgcacatgaaatgtcttgaaaatgttggactccttcgtacggataccattaactttaacggccaagaaattgttccaattcaatttttgaaagccttgcttccagatcctgccagtcttgggccacgtacagtcggaaaaaccaatattggatgtatctttacaggtgtcaaagacggtgtcaaaaagactatctatatctacaatgtctgcgaccatcaggaatgttacgcagaggttggttcgcaagctatttcttatacgacaggagttccagccatgattgggacaaaattagtcatgaacggaacttggaaacaagctggagtgtataaccttgaggagttagatccagatccattcatggaagctttgaatgagtatggtttgccatgggttgtggttgaaaatccacaaatggtggactaa

SEQ ID NO: 79 - DNA, 669 bp, Streptococcus pneumoniae
tctaagagaggagaaaatatggaagcaattatcgagaaaatcaaagagtataaaatcatcgtcatctgtactggtctgggcttgcttgtaggaggatttttcctgctaaaaccagctccacaaacacctgtcaaagagacgaatttgcaggctgaagttgcagctgtttccaaggactcatcgaccgaaaaggaagtgaagaaggaagaaaaggaagaaccccttgaacaagatctaatcacagtagatgtcaaaggtgctgtcaaatcgccagggatttatgacttgcctgtaggtagtcgagtcaatgatgctgttcagaaggctggtggcttgacagagcaagcagacagcaagtcgctcaatctagctcagaaagttagtgatgaggctctggtttacgttcctactaagggagaagaagcagttagtcaacagactggttcggggacagcttcttcaacaagcaaggaaaagaaggtcaatctcaacaaggccagtctggaagaactcaagcaggtcaagggactgggaggaaaacgagctcaggacattattgaccatcgtgaggcaaatggcaagttcaagtcagtagacgagctcaagaaggtctctggcattggtggcaaaacaatagaaaagcttaaagactatgttacagtggattaa

SEQ ID NO: 80 - DNA, 1524 bp, Streptococcus pneumoniae
aaaagcttaaagactatgttacagtggattaagaatttctctattcccctaatttacctgagttttctattactttggctttattacgctattttctcagcatcttatcttgctttgttgggctttgtttttctgctagtctgtctctttatccaatttccgtggaaatctgctggtaaagttctaataatttgcggaatctttggattttggtttgtttttcaaaattggcaacagagtcaagcgagtcaaaatctggcggattctgttgaaagggtacggattttgcctgatactattaaggttaatggtgatagtctatcctttcgtggcaagtctaacggtcgtgctttccaagtctattataaactccagtccgaggaggagaaagaagcctttcaagctttaactgacctgcatgagataggactagaagggaagctttcggagccagaagggcagagaaattttggtggctttaattaccaagcctatctgaagactcagggaatttaccagactctcaatatcaaaacaatccagtcacttcaaaagattggcagttgggatataggagaaaacttgtccagtttacgtcgaaaggctgtggtttggattaagacgcactttccagaccctatgggcaattacatgacaggactcttgctgggacatctggacaccgactttgaggagatgaatgagctttattccagtctaggaattatccacctctttgccctatctggcatgcaggtaggttttttcatgaatggatttaagaaacttctcttgcgattgggcttgacccaagaaaagttgaaatggctgacttatcccttttcccttatctatgcgggactaactggattttcagcatcggttattcgcagtctcttgcaaaagctactggctcaacatggggttaagggcttggataattttgccttgacggtgcttgtcctctttattgtcatgccaaactttttcttgacagcaggaggagtcttgtcctgcgcttatgcttttatcctgaccatgaccagcaaagaaggggaggggctcaaggctgttactagtgaaagtctagtcatctccttgggcatattgcccattctatccttctattttgcggaatttcaaccttggtctatccttttgacctttgtcttttcctttctttttgacttggtcttcttaccgctcttgtctatcttatttgtcctttcctttctctatccagtcattcagctgaactttatctttgaatggttagagggcattattcgcttggtctcgcaggtggcaaggagaccacttgtctttggtcaacccaacgcatggcttttaatcttattgttaatttccttggctttggtctatgatttgaggaaaaacattaaaggattaacagtattgagtttattgattacaggtctctttttccttaccaagtatccactggaaaatgaaatcaccatgctggatgtggggcaaggagaaagtattttctacgggatgtaa

SEQ ID NO: 81 - DNA, 261 bp, Streptococcus pneumoniae
aataatagggattttaaggagtttgatatgtataacctattattaaccattttattagtattatctgttgtgattgtgattgcaattttcatgcaaccaaccaaaaaccaatccagcaatgtatttgatgccagttcaggtgatttgtttgaacgcagtaaagctcgcggttttgaagctgtaatgcagcgtttgacagggattttagtctttttctggctagccattgccttagcattgacggtattatcaagtagataa

SEQ ID NO: 82 - DNA, 867 bp, Streptococcus pneumoniae
aatagaaatagttggaggaaatatatgctctcatggttagcacgcgttattaaagggattgtaattgctcttggatttatcctaccgggaatttccggaggggttctagcagcaatcttaggaatctatgaacgaatgattggctttctggcccatccctttaaagactttaaagaaaatgttttgtactttattccagttgccatcggtatgcttctgggaatcggcttattttcctacccgattgaatacctgcttgaaaattatcaggtttttgtattatggagctttgcgggagctattatcggtacagttcctagcctcctcaaagaatcaactcgagaatctgaccgagacaagattgatttagcttggttatggacaacctttatcatttctggattaggactctatgccttaaattttgtcgttggaaccttaagcgccagctttcttaacttcgtcctagcaggcgcactattggcccttggcgtcttggttcctggcctcagcccatcaaatttacttttgattttgggactctatgctcctatgttgactggttttaaaacttttgatttcttgggaaccttctttccgattggaattggtgcaggtgcaactctcatcgttttttcaaaattgatagattatgccttaaacaactaccactcacgcgtctatcatttcatcatcggtatcgtcctatcaagtacccttttgatcttaattccaaatgcaggaaacgctgaaagtatccaatacacaggactttcacttgtcggttatgtcatcatcgccttcttctttgcgctgggaatctggcttggtatttggatgagtcaattggaggataaatataaataa

SEQ ID NO: 83 - DNA, 636 bp, Streptococcus pneumoniae
atcatgttttacttgagtttgtcaaggattgctttaagctcctctactagtttagtttctgtctctgctgagccattttcttctttcacgaaatcaagggtttcttggagaaggttttgggctttggcaaggacttttttatccgctttttctgcatctagctgtcctagaaccttgatcaattccgtgcttaattgctggatttctgactctttcttacggcgaatcagccagaaggcaatcacgcctaggagggcaagtagactgaccacaatcactcctgccggaactgagtttgtttcagtcatcttatctgaatccttactatcttccgttccttgttttgcatccttcttgtcctgtgcaggcttgctgtcgctagcatttgctttcacatctttgagagagtccaaggcagcccagccttcacagactctactgcagtatgcagaccttactctgtcaaggcactatcttccggagctttttgagcatctaggaggacagccttggttgcatcgattttcggatcagatactgttgccaaagctttcaagcgttggtctaactcttgactcaaggcacgaagttcagacttgtcaacttgctcttgagcttgtgtgctcgttgagctag

SEQ ID NO: 84 - DNA, 744 bp, Streptococcus pneumoniae
aataggattagaattattaagaaagttggttctttattggaaacgatagtatttttaatctctgtttttctagcaggtgttttatcctttttttctccttgtatttttcctcttctgccagtctatgctgggattttattggatgatcaagaaagtgcaaaaagcttttctttgtttgggagaaaggttctctggtcaggcttgattcgaacactttgctttatcgctggtatctctctcattttctttattctaggctttggtgctggttactttggtcatattctctatgcaaattggtttcgatatggcatgggagctattattatcattttgggtcttcaccagatggaaatttttcatttgaagaaattagaagttcaaaaaagttttacctttaaaaaatcagattctaatcgttattggtcagcttttttacttggtattacctttagctttggttggacaccttgtattggtccagttttaagttctgttttagcacttgcggcttctggaggcaatggcgcttggcaaggagcgatttatactctcatttacactctgggcatggcccttcctttcttggtattggcactagcttcaggtctagtcatgccatattttagtaaaatcaagcgtcatatgatgctactaaagaaaattggtggtttcctcattgttttaatgggaattttgttactattaggacaagtaaatgttctagctggaatttttgaataa

SEQ ID NO: 85 - DNA, 936 bp, Streptococcus pneumoniae
atggttaaggagttgttcatgaagaaacaaaatttatttttagtcctgttaagtgtctttcttttgtgcttgggggcttgtggtcaaaaggaaagtcagacaggaaaggggatgaaaattgtgaccagtttttatcctatctacgctatggttaaggaagtatctggtgacttgaatgatgttcggatgattcagtcaagtagtggtattcactcctttgaaccttcggcaaatgatatcgcagccatctatgatgcagatgtctttgtttaccattctcatacactcgaatcttgggcaggaagtctggatccaaatctaaaaaaatccaaagtgaaggtcttagaggcttctgagggaatgaccttggaacgtgtccctggactagaggatgtggaagcaggggatggagttgatgaaaaaacgctctatgaccctcacacatggctagatcctgaaaaagctggagaagaagcccaaattatcgctgataaactttcagaggtggatagtgagcataaagagacttatcaaaaaaatgcgcaagcctttatcaaaaaagctcaggaattgactaagaaattccaaccaaaatttgaaaaagcgactcagaaaacatttgtaacacaacatacagccttttcttatctagcgaagagatttgggcttaatcaacttggtattgcaggtatctctcctgaacaagaaccaagtccacgacaactaacagaaattcaggaatttgttaagacctataaggttaaaacgatttttacagaaagtaacgcttcttcaaaagtagctgaaactcttgtcaaatcaacaggtgtgggtcttaaaactctgaatcctttagagtcagacccacaaaatgacaagacctatttagaaaatcttgaagaaaatatgagtattctagcagaagaattaaagtga

SEQ ID NO: 86 - DNA, 390 bp, Streptococcus pneumoniae
aaggaaaacagtatgttaaaaaatctaaaatcgttcttgcttcgaggaaatgttattgaccttgctgtcggtgttgtaattgcctctgcttttggtgctatcgttacttcacttgtaaacgacattatcactcctcttattttaaatcccgctttgaaagctgctaaagttgaacgtatcgctcaactttcttggcatggagtcggctatggtaacttcttaagtgctattatcaattttatctttgtgggtaccgccctcttctttattatcaagggcattgaaaaagcacagaagctgactggcataaaggaagaaaaaactgacgaaaaaaaaccaaccgaattggaagtccttcaagaaataaaagctctccttgagaaaaaataa

SEQ ID NO: 87 - DNA, 1023 bp, Streptococcus pneumoniae
gaaatgcatgcaaaaatgcgaaataaaaaacaaataaacctaggcataatttttataatctgcctaggtcttcttattacaatatttttgtcattaaagcttggaacaaaagaaattaatatcagagattttttagcagcttttggaatgggtaatacaaatgatgattttattaaatcaattatatataaaagaatacctagaactatttttgcaattttagcaggttctagtcttgccataagcggtgtattgatgcaatcagttactagaaacccaatagctgatccaggtatactcggtataaacacaggagcaagtcttagtgtagtaattggtctttcttttttaggaatttcatcaagcataagccatataagttttgcaatcattggtggcttagtaagtgcaatttttgtatacgcgattgctgtaagcggaaaagcaggccttacccctataaaacttgccttatcaggaacttgtgttagtatggctttaagcagttttgtaagttttttaattttaccgaataataacgtcttagacaaatttagattttggcaaataggtagccttggagcagctacattatcttctatatctacactactaccttttataattttaggtcacttgatagctatatttatttcatcagatttaaacgctttagctatgggtgatgaaatggctgttggtcttggagttaatgttaataggataagatcacttgcaataattgcaagtgtgcttttatgttcaagtattactgcaattggtggacctattggcttcgtaggtcttatagttcctcacttttgtggcttatttataagcaaagatatacgcacaatgaccatttcttcatcttttataggtgcagagctcttgcttatatgtgatataatcggccgtatgttaggtaaaccaggtgaaattgaagtagggataattactgcaataatcgggggtccagtacttatttatgtaactatgaaaaatagaggggttaataactaa

SEQ ID NO: 88 - DNA, 1011 bp, Streptococcus pneumoniae
ctaatgcaaaatttaattataggtattcaaaaaagaaaaaatagaataacactattttcctcactatttttattaataataatcagtctatcatttttcattttacttatcggagatgaaagttattctttttcaactttgattaaagtcttaaatagtgaaactgttcctggagctagtttttcgattatggaaattagattaccaaaattattagcaggaattatagctggctggtcttttggattggcaggatttatctttcaaactatgttaagaaatcctcttgcaagtcctgatataatcggtgtcacaagttcttcatctattgcagcggtcttttgcatattggtattaaaaacaaatagtttaactactggaattatttcaataacttgtggactaacatcatctttaatattatttttactagctaaaaaagatggtttttcagcagcaagactgataatattaggtattggttttcaagctgtcacaagagcaggcacctcatttttattgttgaaagtagcaagatatgaattacaagaagttatgagatggctcagtggctctttatcttttacaaagttagatgacatacctcttgttctaatagtaagtattattgctactatattagttttattttttaataaaagactagaaattattgaacttggtgaagaaatagcaatcggacttggagcaaatcccgagctttcaaggcttgttttaattttttgcgctgtatctttaactgctttttctacttcaattacaggaccaatagcttgtatatcttttttagctggtcccatagccttaaatattggcaagaaaagaagcccaatattagctggattggttggaattttactagttttgttatcagacatattctctcaaaatattttaccagctagatatccagtaggtgttgtaactggcttgttaggttcaccatacttaatatacttactaataaaaatgaacaggaggaatatataa

SEQ ID NO: 89 - DNA, 936 bp, Streptococcus pneumoniae
aataaaggtaggggtgttatgaattgtttcttgaaaatgaataatgtaagtgttcgttatgatgacgtaatagctttaaaagatataactttacaaataaataagggagatttcattggcttattaggttcaaatggtgcaggtaaatctacgttaattaattctattgtaggttttcaagagatttatttaggagaaatagagtattgtgataaagatttgatagttagttctcaaccttttgctcatttaggctttactcctcaaaccacagtaattgatttttatactactgtgaaggacaatgtaatattggggctgaaccttgctggaaagtttgggaaaaatgctgagaagttgtgtcaaatagccttagaaattgttgggttagctgataaaaaaaataatttggtagaaacattgtcaggtggacaactgcaacgcgtccagattgctagagcaatagctcataatccagatttttatattttagatgaacctaccgttggtttagatactgaatctgccgaaaaatttttaatgtatttaaaagataagagtttggaaggaaaaactattatcatatcttcacatgacataaatctactcgaaaagttttgtaaaaaaatactttttttacaaaatggctccatatcattttttggtgatatgcgtgactttgtagataattcaactatcaaattaaatttttcaatgcagaatagaatttctagatatcaaattgaatttttagaaaattttagatttaaagttcacatcgaagataatgatagttttacaatagaagtccctatagaagaaaagatcttagatgttatcaatgaggtaggaaaagcatgtgaaattaaaaacttttcaacaagtaaattaaccttacaagaaagttatttgcaaagaataggaggagaaaaatga

SEQ ID NO: 90 - DNA, 846 bp, Streptococcus pneumoniae
attaaccttacaagaaagttatttgcaaagaataggaggagaaaaatgaaggctgatcaattaaggcacaaatcggacttaggtttaagaggtctagcgattattgctaaaaatgagattattgctttttttagaagtaaaggtttaattatttctcagtttctacaaccaatcttatatgttgtttttataataataggattaaattcttcgataaagaacattcagtttaatgatataaaaacctcttatgcagaatatacaatcattggtgttatagctttattgataatcgggcagatgactcaagttatttatagggtgacaatagataaaaaatatgggctacttgctcttaagttatgcagtggagttcgtcctttatattatattttagggatgagtatctattctatattagggttgatagttcaagaaattattatatatataattacgttagcgtttgagataaatatcgcaatggatagatttttttatacagttttgttatctattgttgttttattattttgggactcccttgcaattttacttacaatgtttatcaatgattacagaagacgtgatattgtaatacgttttgtactaacaccgcttggttttacagctcctgttttctacttaatagattctgctcctagtattgtgagatggattggtcagttaaatcccttaacttatcaattaactattttgagaaacttttattttaaaaattcaacaactttggaattagttttcttattgttaacatcattacttgtccttatatctgtatcttttattataccaaagataaaattgatactgatagaaagataa

SEQ ID NO: 91 - DNA, 1038 bp, Streptococcus pneumoniae
aatatgttaaaggaaataaaaaggagaaacagaatgaaaaataaacgtttaattggaattattgctgcattagcagtcttagtagcaggaagcttgatttattcttcaatgaataaatcagaagctcagaataataaggatgagaagaaaataaccaagattggtgtgcttcaatttgtgagccatccatcccttgatttgatttataaagggatccaagatggacttgcagaagaaggatataaagatgatcaagttaaaattgattttatgaactcagaaggtgaccaaagtaaggttgcgacaatgagtaaacaattggttgcaaatgggaatgaccttgtggttggtatcgcaacaccagcagcccaagggttggctagtgcaacaaaagacctaccggttatcatggccgctattacagacccaattggtgctaacttggttaaagatttgaaaaaaccaggtggcaacgttacaggggtatctgaccacaatccagctcaacaacaagttgaactcatcaaggctctgacaccgaatgtgaaaacaatcggagctctttactcaagtagcgaagacaattcaaaaacacaggtcgaagaatttaaggcttatgctgaaaaagcaggtctgacagtggaaacatttgcagttccttcaacaaatgaaattgcctcaactgtcactgttatgactagcaaggtagatgctatttgggttccaattgataacaccattgcatcaggatttccaacggttgtctctagcaatcaaagttctaagaaaccaatttatcccagtgcgacagctatggtagaagtaggtggtttggcatcagttgtaattgaccaacatgaccttggtgtggcaacaggtaaaatgattgtgcaagtcttgaaaggtgcaaaaccagccgataccccagtcaatgtcttttcaactggtaagtcagtcatcaataaaaaaatagcacaagaactaggtattactattcctgagtctgttctcaaagaagcaggacaagtcatcgaataa

SEQ ID NO: 92 - DNA, 792 bp, Streptococcus pneumoniae
gcaaacaatcttgaaaggagccaagttaagcaaatgacagcaattgtagaattaaaaaatgcaaccaaaatcgttaaaaatggctttgatgaagaaaagattattttaaatgatgtttccttagaaatttttgaacgggactttatcacgattttgggcggaaatggtgctggaaaatcaactctctttaacactatagcagggaccttatcactaactagtggaactatccgtattttaggtgaagatctcactaagttttcacccgagaagcgtgccaagtacctgtctcgtgtcttccaagatccaaagatggggacagctccccgtatgacggtcgctgaaaatcttttaatcgccaagtttcgtggtgaaaagcgtggattgttaccacgacgcttgactagctataaggatgaatttcaggcaaccattgaaaaagtaggaaatggtcttgagaaacacttgaatacaccgattgagttcttatcaggtggacaaagacaggctttgagtctcttgatggcaaccttgaagcgacctgaattactcctgttagatgagcatactgctgccctggatccaaagactagtgttgctttgatggaattgacagatgaatttgttaagaaagatcagctaacagcccttatgattactcatcatatggaagatgctctcaaatacggcaatcgcttgattgtcatgaaagaaggacgaattatccaagatttaaaccaagaagaaaaagcaaaaatgaaaatctctgattattatcaactctttgaataa

SEQ ID NO: 93 - DNA, 741 bp, Streptococcus pneumoniae
aaagaaaatggtacaatatttctaagagaaaatacaatgggaggtaaaatgaggttattacctataagaaaaatatcacgtcagtctaaaaggttagcactttttttgacgttttgtgctggatatgtggatgcttacacttttattgttcgcgggaatacccttgtagctggacaaactggaaatgttgtctttctttcagtagaattaattaaaaataatgtttcggatgttagggacaaggttctcaccttgctagcgtttatgatgggagtctttttattaacgatttataaggaaaaattgagaattgtgaaaaaacctattctgtccttgattcccttggcaatcttatcaatcattattgcttttgtgccgcaaactgtggataatatctatctagtgccgcccttggccttctgtatgggactggtgacaactgcttttggagaagtgtcgggtattgcctataataacgcttttatgacagggaatatcaaacggaccatgctggcttttggagattatttccgaaccaagcacactccttttttgcgtgaaggattcatatttgttagcctgcttagtagttttgtccttggcgttgtcttttcagcctatttgacgattttctatcatgaaaagaccattcttggtgttcctattatgatgagcgttttttacctcagcatgctttttgcctcttggcagaaaaaagtaaaagaaaaagcttcattttag

SEQ ID NO: 94 - DNA, 864 bp, Streptococcus pneumoniae
gaaaagaggtgtcctatgattaaaaaaatttaccccatttttaccattttactaggtgctgctatttatgcttttggactgacttattttgtagttccccatcatctctttgaaggaggggcgacaggcattaccctcatcaccttttatctttttaaaatccctgtttccctcatgaacctgctgattaatattccccttttcatcctagcttggaagatttttggagccaaatccctctattctagtttactaggaaccttagctttgtccggctggttagctttttttgagcatattccccttcatattgatcttcaaggtgatttactaatcacagcccttatagcgggaatcctattgggaattggccttggaattatttttaatgctggaggtacaactggcggaactgatattctagctcgtattctcaacaaatacactcatatatccataggaaaactgctctttatcttagatttttgtattctcatgttgattctcctaatcttcaaggatttgagattggtttcctacacgcttttgtttgattttattgtttctcgtgttattgatttgattggtgaaggaggatatgccggcaaaggctttatgattatcacaaaacgtcctgaccaacttgctaaggcgattaatgatgacctcggaagaggtgttacttttatttctggtcaaggctactatagtaaagaaaatttgaaaatcatctactgtattgtcggaagaaatgaaattgtgaaaacgaaggaaatgattcatcgaatcgatcctcaagcctttataactattacagaagcccatgaaatcctaggagaaggcttcacctttgaaaaagaataa

SEQ ID NO: 95 - DNA, 300 bp, Streptococcus pneumoniae
aaattatttggaggaatcattaacatggcaaacaaacaagatttgatcgctaaagtagcagaagctacagaattgactaagaaagactcagcagcagcagttgaagctgtatttgcagcagtagctgactatcttgcagctggtgaaaaagttcaattgatcggttttggtaactttgaagttcgtgagcgcgcagaacgtaaaggtcgcaacccacaaactggtaaagaaatgacaattgcagcttctaaagtaccagcattcaaagctggtaaagctcttaaagacgctgttaaataa

SEQ ID NO: 96 - DNA, 1095 bp, Streptococcus pneumoniae
tatacttacttatggagaaaatacatgaaacgtgagattttactggaacgaatcgacaaactaaaacaactcatgccctggtatgttctggaatactaccaatctaagctggctgtgccctacagttttacaaccctgtacgaataccttaaggaatatgaccgatttttcagctgggttttggagtctggtatttcaaacgctgataaaatatccgatattcctttatcagttttggaaaatatgtctaagaaagacatggaatcctttatcctttatctacgtgaacgtcccttgctgaatgctaatacaacaaaacaaggtgtttcacagacaactatcaatcgaaccttatcagcactttctagtctttacaagtatctaaccgaggaggttgaaaacgatcagggggaaccttatttctatcgtaatgtaatgaaaaaagtttccaccaagaaaaagaaagaaacccttgctgccagagctgaaaatatcaagcaaaaactctttctaggtgatgaaacagaaggttttctaacttatatcgatcaagagcacccacaacagctttcaaatcgagctctctcatcattcaacaaaaataaagaacgagatttagccattattgcccttctcttggcatctggtgttcgcttatctgaagctgttaatctagatctaagagatctcaatctaaaaatgatggttattgatgttactcgaaaaggttgcaaacgtgactcagtcaatgtcgctgcttttgctaaaccttatttagagaattatctggccattcggaatcaacgctataaaacggaaaaaacagatacagccctttttttaactctctacagaggtgttcctaatcgtatcgatgcttctagcgttgagaaaatggttgctaaatactcagaggattttaaagtgcgtgtaacaccccataaactgcgccatacactagcaactaggctctatgatgcgactaaatcacaagttttagtcagtcaccaactaggacatgctagcacacaagtcactgacctctatacccatattgttagtgatgaacaaaagaatgctctggatagtttatga

SEQ ID NO: 97 - DNA, 405 bp, Streptococcus pneumoniae
ctgagggctgcaccgacagcgatccccataccaccacctacgataccattggcaccaaggttcccagcatcaaggtcagcgatatgcatagatccacctttccctttacaggttccagtgtatttaccaaggatttcagccatcattccgttgaggtcaatccctttagcaatagcttgcccgtgtccacggtggtttgaggtaatcagatcatctggattgagagctaacatagcccccacgttagctgcctcttcaccaacagaaaagtgcgtcattcctggcactttccctttctttactaattgtgcaatttttaagtccatgcgacggatttcttccatcttacggaacatttctagcaaaagatttttatctaaagttgacatcttcttgcctttctaa

SEQ ID NO: 98 - DNA, 1716 bp, Streptococcus pneumoniae
actctacaagagaggagttcaataatgaataaactaattgcatttatcgagaaaggaaagcctttctttgaaaaactatctcgtaatatctatcttcgtgctattcgtgatggtttcattgcaggtatgcctgttattctcttctcaagtatctttatcttgattgcctttgtaccaaactcatggggctttaaatggtctgatgaagttgtagcctttctgatgaaaccttatagctattctatgggtattctggctctcttggtagctggtacaacagctaagtcattgactgactcagtaaaccggagcatggaaaaaaccaatcaaatcaagtatatgtcaacattgttggcagcaattgttggtttgttgatgttggcagctgatcctatcgaaagtggtctagctactggattcttggggacaaaaggtttgctttcagccttccttgctgcctttgttactgtagccatctataaggtttgtgttaagaacaacgtcactattcgtatgcctgacgaagttccaccaaatatctcacaagtctttaaagatgtgattccattcactctatctgttgtttctctttatgctcttgacttattagcacgttattttgttggttctagtgtggcagaatcaatcggtaaattcttcgcaccactcttctcagcagcagacggataccttggtattaccattatctttggtgcctttgccttcttctggtttgttgggattcatggtccatctatcgttgaaccagctatcgcagctattacctatgccaatgccgaagttaacttgaaccttctccaacaagggatgcatgcagacaagattcttacttctggtacacaaatgtttatcgttaccatgggtggtacaggtgcgacattggtcgttccatttatgttcatgtggttgacaaaatcgaaacgtaaccgtgcaatcggacgtgcttcagtagttcctaccttcttcggtgtaaatgaaccaatcttgtttggtgcacctcttgttttgaatccaatcttcttcattccatttatctttgctccaattgcaaacgtatggattttcaaattctttattgaaactcttggaatgaactcattcactgctaatctaccatggacaactccagctccactaggtctagttcttggaactaacttccaagtgctatcattcattcttgctgcccttctaatcgtggttgacgttgtcatttactatccattccttaaggtctatgatgaacaaattcttgaagaagaacgttcaggtaagtctaatgatgaattgaaagaaaaagttgctgcaaacttcaacactgcaaaagcggatgctattcttgaaaaagcgggtgtcgatgcagcacaaaataccatcactgaagaaacaaatgtcctcgttctctgtgcaggtggaggaacaagtggtctccttgcaaatgctttgaataaggcagcagcagaatacaatgtccctgtgaaagcagcagcaggcggctatggtgctcaccgtgaaatgttaccagagtttgatcttgttatccttgcccctcaagttgcttcaaactttgaagatatgaaagcagaaacagataagctcggtattaaactagcgaaaacagaaggcgctcaatacatcaaattaactcgtgatggaaaaggtgctcttgcattcgtacaagcgcaattcgattaa

SEQ ID NO: 99 - DNA, 807 bp, Streptococcus pneumoniae
gagtttattatggtttcttcggaatttatctcaaagattgaatttgcttgcaataagaaagaaagtctttatagtcaaagcaaatttaagtatgcgattcgttcgatgttcgcaggtgcatttttaaccttcagtactgctgcaggtgcagttggggctgacttgattaataaaattgcaccaggtagtggacgcttcctctttccattcgtttttgcttggggcttggcctacattgtttttttgaatgccgagttggtcacttcaaacatgatgttcttgactgctggtagtttcttaaaaaaaatctcttggagaaaaacagctgagattttactatactgtaccttgttcaaccttatcggagccttgatagcagggtggggctttgctcattcggcagcctatgcgaatctgacacacgatagtttcatctcaggtgttgttgagatgaagttaggccgctcaaatgaattggtcttgcttgaggcgattttggcaaatatttttgtaaatattgcgattctgtcatttattttggtcaaagatggtggtgccaaactttggcttgtgttgtcagctatttacatgtttgtattcttaacaaacgagcacattgcggcgaactttgcttctttcgcgattgtgaaattcagtgttgctgcggattcaattgccaacttcggtgttggaaatatgcttcgccactggggtgtgactttcatcggaaactttatcggaggaggcctcttgatgggtcttccatatgccttcctcaataaaaacgaagatacttatgtagattaa

SEQ ID NO: 100 - DNA, 1356 bp, Streptococcus pneumoniae
gaaataatgcttgatttactgaaacaaaccatttttaccagagattttatctttatcctgattttgttaggtttcatccttgttgtgaccctcttattactggaaaatagacgtgataatattcagttgaagcaagtcaatcaaaaggttaaagatttgattgcaggagattattccaaggttcttgatatgcaaggtgggtctgaaatcaccaatattaccaataatttgaatgacttgtcggaggttattcgtctcactcaggaaaatctagaacaagagagtaagaggctaaatagtattctgttttatatgacagatggggttcttgcgactaaccgtcggggtcagattatcatgattaacgatacagccaagaagcaactggggttggttaaggaagatgttctgaatagaagcattttggaattgctcaagatagaagaaaactatgaattgcgtgatttgattacccaaagtccagaattgttgctagattcccaagatatcaatggcgaatatttgaaccttcgagttcgctttgccttgatacgtcgagagtctggctttatttcaggtttggtggctgttttgcatgatacgacggagcaggagaaggaagaacgcgaacgaagactctttgtttccaatgttagccatgagttacggactcctctgactagcgtaaaatcctatcttgaagccttggatgagggggctttgtgtgaaactgtagcaccagactttatcaaggtttctcttgatgagaccaaccgtatgatgcgcatggtgacggatctcctccatctttcacgtattgataatgctaccagtcacctagatgtggaactgattaacttcactgcttttattacctttatcctcaatcgttttgacaagatgaaaggacaggaaaaggagaaaaaatatgagttggtgagagattatcccatcaattctatctggatggaaattgatacagataagatgacgcaggttgtcgacaatattttaaataatgctattaagtattcgccagatgggggtaaaatcactgtcagaatgaagacaactgaagaccagatgattttatccatttctgaccacggtttggggattcctaagcaggatttaccacgtatctttgaccgtttctatcgtgtggatcgtgctagaagtcgtgcacaaggtggtacaggtctaggactgtctatcgctaaagaaattatcaaacaacataagggctttatttgggccaagagtgaatacggcaagggttcaacctttaccattgtactcccttatgataaggatgcagtgaaagaagaagtatgggaggatgaagtagaagactag

SEQ ID NO: 101 - DNA, 594 bp, Streptococcus pneumoniae
attcttgctttattgtctggtttattgtaccatactagtgtatatgcagttaaaaaggagattcttgtgaatacacggaaaaagacacaatttatgacaatgacagcccttttaacggctattgcgattttgattccaattgttatgcctttcaagattgtcattccacctgcttcctatactttggggagccacatcgctatttttatagccatgttcttgtcgcccttgatggcagtttttgtcatcctagcctctagttttggatttttgatggctggctatcccatggttatcgtttttcgggctttttcccatatatcttttggtgctttaggagctctttacctacaaaaattccccgataccctagataaaccaaaatcttcctggattttcaactttgttttggctgttgttcatgcccttgctgaagtattggcctgtgtcgttttttacgcaacttctggtaccaatgtagaaaatatgttttatgttctatttgtactagttggatttggtacaattatccatagtatggtagactatacattagcactagctgtctataaagtgcttcgaaaacgccgttaa

SEQ ID NO: 102 - DNA, 867 bp, Streptococcus pneumoniae
attgctattaaaaagtgctataataatagtatatatagaagaaaagaggacggggatatgaagaacaaaagaatatttaaagacttccaagcttcaaaaatgagtttaaacatttacacaagccccttgttagcctttgtttttgtcttcataggagagtttgtggcttttactttgtatggtattggcttgttagctctcatcggacttgctagaaattttggagaggctggtcaaaatcttgcaagctacttgcagaccttgcatcagagcttgacggataaaacaagtgactttcgtttaattttaggattactggcctttggttttattcttaacactgtgttcagatggacaagaaaagttgagaaaagacctattcgaaccttgggattttatagagagaatttcctcagcaatcttctgaaaggatttagtctaggcctggcactttttcttctgaccttgttaggtttagtggtcttaggtcaatatcgtttggaatccattcacttgaatccttattctcttgcctttgtcgtctttactatcccattttggattttacaggggacagcagaagaagtggtggcccgtgcttggctacttcctcaattggcctcaagaaccaatctaaaactagctattcttatatctagcctgttctttaccctgcttcatatgggcaattctggtctcacccctctatctctagtaaatctctttttattcggagttgccatggctctttaccttctcaaaactgatacagtttggggtgttgcaggtattcatggtgcttggaattttgctcagggtaatctctttgggattttagttagtggtcaaccgtcagaacgtctctga

SEQ ID NO: 103 - DNA, 2193 bp, Streptococcus pneumoniae
gagaatattcggaaaaggagactaaaaatgaagaaaaaatttctagcatttttgctaattttattcccaattttctcattaggtattgccaaagcagaaacgattaagattgtttctgataccgcctatgcaccttttgagtttaaagattcagatcaaacttataaaggaattgatgttgacattattaacaaagtcgctgagattaaaggctggaacattcagatgtcctatcctggatttgacgcagcagtcaatgcggttcaagctgggcaagccgacgctatcatggcagggatgacaaagactaaagaacgtgaaaaagtcttcaccatgtctgatacttactatgatacaaaagttgtcattgctactacaaagtcacacaaaattagcaagtacgaccaattaactggcaaaaccgttggtgttaaaaacggaactgccgctcaacgtttccttgaaacaatcaaagataaatacggctttactattaaaacatttgacactggtgatttaatgaacaacagcttgagtgctggtgccatcgatgccatgatggatgacaaacctgttatcgaatatgccattaaccaaggtcaagacctccatattgaaatggatggtgaagctgtaggaagttttgctttcggtgtgaaaaaaggaagtaaatacgagcacctggttactgaatttaaccaagccttgtctgaaatgaaaaaagatggtagtcttgataaaattatcaagaaatggactgcttcatcatcttcagcagtgccaactacaactactctcgcaggattaaaagctattcctgttaaggctaaatatatcattgccagcgattcttcttttgccccttttgttttccaaaattcaagcaaccaatacactggtattgatatggaattgattaaggcaatcgctaaagaccaaggttttgaaattgaaatcaccaaccctggttttgatgctgctatcagtgctgtccaagctggtcaagccgatggtatcatcgctggtatgtctgtcacagatgctcgtaaggcaacttttgacttctcagaatcatactacactgctaataccattcttggtgtcaaagaatcaagcaatattgcttcttatgaagatctaaaaggaaagacagtcggtgttaaaaacggaactgcttctcaaaccttcctaacagaaaatcaaagcaaatacggctacaaaatcaaaacctttgctgatggttcttcaatgtatgacagtttaaacactggtgccattgatgccgttatggatgatgaacctgttctcaaatattctatcagccaaggtcaaaaattgaaaactccaatctctggaactccaatcggtgaaacagcctttgccgttaaaaaaggagcaaatccagaactgattgaaatgttcaacaacggacttgcaaaccttaaagcaaacggtgaattccaaaagattcttgacaaatacctagctagcgaatcttcaactgcttcaacaagtactgttgacgaaacaacgctctggggcttgcttcaaaacaactacaaacaactccttagcggtcttggtatcactcttgctctagctcttatctcatttgctattgccattgtcatcggaattatcttcggtatgtttagcgttagcccatacaaatctcttcgcgtcatctctgagattttcgttgacgttattcgtggtattccattgatgattcttgcagccttcatcttctggggaattccaaacttcatcgagtctatcacaggccaacaaagcccaattaacgactttgtagctggaaccattgccctctcactcaatgcggctgcttatatcgctgaaatcgttcgtggtggtattcaggccgttccagttggccaaatggaagccagccgaagcttgggtatctcttatggaaaaaccatgcgtaagattatcttgccacaagcaactaaattgatgttgccaaactttgtcaaccaattcgttatcgctcttaaagatacaactatcgtatctgctatcggtttggttgaactcttccaaactggtaagattatcattgctcgtaactaccaaagtttcaagatgtatgcaatccttgctatcttctatcttgtaattatcacacttttgactagactagcgaaacgcttagaaaagaggattcgttaa

SEQ ID NO: 104 - DNA, 774 bp, Streptococcus pneumoniae
actagcgaaacgcttagaaaagaggattcgttaatggcaaaattaaaaattgatgtaaatgatttacacaagcactatggaaaaaatgaagtcctaaaaggaattacgactaagttctatgaaggagatgttgtttgtatcatcggtccttcaggttctggtaagtcaactttcctccgtagcctcaatcttttagaagaagtcactagcggtcacatcactgtgaacggctatgatttaactgaaaaaacaaccaatgttgaccacgtccgtgaaaatatcggcatggtattccaacacttcaacctcttccctcatatgtctgtattggacaacatcacctttgctcctattgagcacaagttgatgactaaggaagaagctgaggaattgggaatggagttgcttgaaaaggttggactagcagataaagctaatgccaatccagatagcctatcaggtggtcaaaaacaacgtgtggccatcgctcgtggcctagcaatgaatccagacatcatgctcttcgatgaaccaacttctgcccttgaccctgagatggttggagacgtacttaacgttatgaaggaattggctgagcaaggcatgaccatgattatcgtaacccatgagatgggatttgctcgtcaggttgccaaccgcgttatctttactgcagatggcgagttccttgaagacggaacacctgaccaaatctttgataacccacaacaccctcgtctgaaagagttcttagataaggtcttaaacgtctaa

SEQ ID NO: 105 - DNA, 372 bp, Streptococcus pneumoniae
ctaggagaagttatgcgtattatctatctaattattggttttttatcgctgaccttggctattgttggggttgttttacccttgttgcctacaacacctttccttttgttgtctattgcttgtttctccagaagttccaagcgattcgaagattggctttatcataccaagctctatcaagcatatgtagctgattttcgtgagaccaagtctattgcgcgtgaacgaaagaaaaaaatcatcgtctctatctacgtcttgatgggaatttctatttattttgcacctcttttaccagtcaaaatcggtctgggtgctttgaccatctttattacttattatctcttcaaggtcattccagacaaagaatag

SEQ ID NO: 106 - DNA, 555 bp, Streptococcus pneumoniae
tactgtacgttttatcatagaaatttttactttattttctcatcaaatgagatttgcatcaatctcttgtcttacttgcgtttcttcttcgctttcttcattttgttagccatacgtttcatggactgtttcatggcaaattcaccaattttacctttcaaaccgccaccaaacatctggctcatatctggcattcctgctcctccgagagctgataagtcaggcataccgccttgtcccatcattccttcaagggcagacatatccattcctcccatatttggcatatttttaggaaggttatttggattaatccccatttgcttcatcattttattcatatccccagacataacaccctgcatgagctgtttagcctggttaaagtccttgatgaatttattgacttcgacgaatgtatttccagaaccagcagcaatacgacggcgacggcttggatttaacaaatctgggttttcacgctcttcaggtgtcatcgaagacacaatggcacgtttacgagcaatctggcgttcatccaccttcatgttttga

SEQ ID NO: 107 - DNA, 396 bp, Streptococcus pneumoniae
ttatcaggatcaaaatatcaaatgaaaaaagaacaattttatccgctaggaatttttctagctgctatgttgggcggacttgtccgatatctagtttccacctggttaccagccagtccagatttcccttggggcactctctttgtcaactatctgggaattttctgcttgatttatcttgtcaagggctatctggtctataaggggactagtaagggcttgattttagcactggggacgggtttttgcggaggtttaacaactttttccagcctaatgcttgatactgtgaagctgcttgatacagggcgttatcttagtttgatactgtatttgcttttgagtatcggtggaggcctgcttttagcttactatttggggaggaagaaatggtaa

SEQ ID NO: 108 - DNA, 1998 bp, Streptococcus pneumoniae
aaaaatatggccattagtcagatgaaaagaatctctctactattttctaaaagtagtcttgatgatgttttaaaaactattcaagaactagagtcagtgcagttccgtgatttaaaggttcaggataactggtcagaagctctagaaaaagatgaagttgtatttccaactattcaaatttttcatacttctaattccaatcatggggttattgagggaaatgatgccttgacttatttgatgaatcaacaacaacatttagaagcaactgtagagaaattacaagaatacctaccgaaagaaaacacgtttaaattattgcagcaacctccgataactacctcttatgaagaattagagaaatttggtaaagctaatgttgctgagggtgttcttaaaaaagtgaatcatcaaattaacagagttcatgaattagaaagacacattcaaagtaataatgaggaaatagagcgattaataaagtgggaaaaattagaaattgttcctgcgaatttagaacaattttctttctgtaaaggaaaagtcggaacaattccaaggactgaagataatcgcttatacaatagtcttttagaaaacaatattgaagttcaagaaatattttctaatgatagagagtacggtgttgttgttttctatcagtctagttactctatagattttgatgaatacttatttgaaccatttgattattctagaaaggaattaccgaagcagcgagtagtagatttagatcaagaaaacatgcagttaataactgaaaaagagaatattatcgcatcgttgcaagattcaaagaaatatttgatagatttacaatggcaaatagactatattttatctatctatgctcgtcaaatctctaagaataactttttgtgcactccgcatctagttgcattagaaggatggatagaagaaactcgtattttatattttataaaagttatggatgagcattttggacattctatttatatttatgaatcggaaacattgacggataatcaagatgaaatacctatcaaattaacgaatcattctttaattgaaccatttgaattattgacagaaatgtatgctctgcccaaatattatgagaaagatcctacacctgtattagcaccattttactttacattttttggaatgatggttgctgatttaggctatggtttactattgtttttaggaacaatgttagcattaaaaatttttcatctaccttcagcaactaagagatttttaaaattctttaatatattaggggtagccgttgcaatttggggtggaatctatggctcattttttggatatgagttgccatttcatctgatatctacaacctctgatgtcatgactatattagtagtgtcagttgtgtttgggtttattacagtatttgcaggtttgttagcttcaggactacaaaaagtaagaatgaataaatatgcagaagcatataattcaggatttgcgtggtgtgttattctgcttggcttgttatttattgctgttggaatgttgatgcctgatatgagaccgttatttgtattagggaaatgggtatctatttttaatgctgtggggattttgattgtttctattattcaaaccaaaagcttgtcaggtattggagcaggattgtttaatctatataacatttcatcttatataggtgatttagttagtttcactcgattgatggcattaggattatctggagcaagtatagcatcagctttcaatttaattgttggtttgtttccgggaatattggctaaactgacaattggattagtattattcattcttttacatgcgatcaatatttttctatcgttactatcaggatatgttcatggagcacgtctgatatttgttgaattttttggtaagttttatgagggtggaggaaaaccatttcaacctttgaaggcttctgagaaatatattaaggttattacaaagaattaa

SEQ ID NO: 109 - DNA, 915 bp, Streptococcus pneumoniae
gatcaaaaatgtgggagtgttgaaatgaagattataggtatcgatattggcggaacaacaattaaggcagatttatacgatgagtttggaacgagtttgaatcatttcaaagagatagaaacaattattgactatgatttgggaacgaatcagatattaaatcaggtctgtgatttaattggtgagtatactttaaatcattcaattgatggtgttgggatttccactgctggagttgttaatgctaatactggagaaatcatctatgcaggctatacaataccagggtatatcggagtaaactttactgccgaaatagaaaaacgttttgggttgtatacttttgttgaaaatgatgttaattgtgctgcattaggtgaattgtggaagggacaagccaaagataagaaaaatgtagtaatggttactattggaacaggtataggaggcagtattattgtcaacggacaaattgttaacggatttaactatactgctggtgaagtaggttatattcctgtaggtaattcggattggcaaagtaaagcctcaacaaccgcattgattcatttatatcaaaaaaagagcttgaaaactaatcaaactggacgtactttcttcactgatttaagatctggagataaagttgctgaagaaacttttgaaatttttgtagaaaatctaacaaaaggtttattaacgatttcttatctacttaatccagaaattctcatattaggaggtgggattctggatagtaaggatattttgttacctgaaattcaaagttctttagctaaaaatgcaatggataataggtttttacctaaaaatcttgtggcagctacattaggaaatgaagctggtcgtataggagctgtaaaaaatttcttagatagaatttctaataaatag

SEQ ID NO: 110 - DNA, 930 bp, Streptococcus pneumoniae
aggagaaatctgatgaaagatttaactaaatacaaaggcgttatccctgcattttatgcttgctatgatgaaaatggtgaaattagccaagatcgtgtaaaatctctggtacaatatttcattgacaaaggtgtaaaaggtatctatgtaaatggttcttcaggtgaatgtatttaccaaagtgtagaagatcgtaaacaaattattgaagctgttatggaagttgctaaaggtaaattaacagttatcaaccatattgcatgtaataacacgaaagatagtatcgaattggcaaaacattcagaaagtgttggagtcgatgctattgcagctatcccacctatttatttcaaattgccagagtattcaatcgcagcatattggaatgcaatgagtgaagctgcgtcaaatacagattttattatctataatattccacaattggcaggggttgcgttgactggtagtttgtatgcaacaatgcgtcaaaatcctcgtgtgattggagttaaaaattcttctatgcctgtacaagatattcaaatgtttgtagctgcaggtggagaagattacattgtattcaatggtccagatgaacaatatcttggtggtcgcttgatgggagcagaagctggtattggtggtacttatggcgttatgccagatttgttcttgaaattggaaagtttgattcaagaacgagatttagatacagctaaaaaacttcaatatgctatcaatgaagttatctataagatgatatcaggtaaggcaaatatgtatgctgtagcaaaagaagttttgcgtctaaatgaaaaacttgatttaggttctgttcgtcaacctttagaagcattggcagaaggtgacttggaagttgcaaaacaagcagcagaacttattcaacaagcacgaaaagaatttttataa

SEQ ID NO: 111 - DNA, 759 bp, Streptococcus pneumoniae
gtgattggaggcaagaatatggataaagattatatattaaaagtgaaagggctgtatcatcaatttttactaggaaataataaaacgttgcaagtgctgaaaaatgtttctctttctgcttcgagaggagaatttataagtattctaggaattagtggttctggaaagtcaactttattaaaatgtatttctagtttgcttgaaccaacaagtggggaagtaattttaaatggaatcaacccctataaaatcagaaatgcaaaattgtcaagtataagacgtaacgaagtatcttttatatttcaagcatacaatttaataccttccctgccggtaatagaaaatatagcacttcctttgcgattatcacaaaaaaaattaactattaaaaatgtagaaaacttactcaaaagaatgaagtttaatgctggcttaaacgattttgttggaactctgtctggtggagaacaacagaaggttgctatagctagagcggttattgctgatagtgatataatatttgctgatgagccaactggggctttagacagcgtttctcgtgaagtaatttttgaattattgagagagttagtaggggcgggtaagtgtgtaattatggtaacgcacgatatagaattggcctcgaaaactgatcgtgcattaatattgaaagatggaaaaattttcaaagaacttcatagacctagcggggaagagttgtataaaatcttagaggtacaatcaactacggaggaatag

SEQ ID NO: 112 - DNA, 1611 bp, Streptococcus pneumoniae
cttatgaattatttaaaatttataaaaaagactaaacttatattaatggggattttaatatttctatcttcgtttaatggtgtcttgctctcaggaattattgtatatgcaggtagtttaaatcagacttcctcattttctgacgttctaagatttggtgctataagtattctgggttggtcagcaatctatatatcaaattactatttagaagtaacggaagcatcaataactaaagatataaatgtaaaaattaaacaaggatattttagagaacagtatctttcttctgaaatggttaaagattactcatctattatttcagttttgtcaaatgatttgagattaatcgaagaaaactattttagacaaatttttgaaataatttcttcaatattgttgttcatcgtctctctaagttttatgctttatttaaacttcctagtttcaataatatttattgtattatcagcattgccgattatagtacctgtctttatgaagaagatgttgtctaattcagctaatgagtactctaacagcaatgcagagtatactcacataataaaagaaatttttaatggttttaagacattaaaatcttattctgttactaaagaaataattagtttgtcggataaaaagttggataaactagaagattctacttttaatttgaaacgatcagaggttctttcaaaattggttgcagtactaatttcaggtttttgctttctagttcccttggttgtaggatgttattttgtaatttatcataaaagcctttcttttagtgaactgataggtattttcttagcaaacgataaagttttagggccgatacaatcaattgcctattcattaaataagataaatacaaccaaagatttaaggaaaccgtttttaaaatacttaagtggagagaagaattttatagacgctgaacatgataataacggactgtatacttcatcaatagatgagatacacatgaaagatgttgtatattctattacaccagaaaataaattaagtattgacttctcatttaagtcaccatttagggtattattaacaggaacttctggtagtgggaaaacaacgattttaaatttaattaatggttctttaaagccacaaaaaggttatgtaaatttgttatcacatgggaaaaagagttcagattcaataccaacagttgatcagacaccatatatttttgacactactattcgtgagaacgtaactttatttcaaaatgaatatttttcagatgatcagataattgaggtgttaaaaaaggtaaatctatatgaagaattagaaaagatagatatactaaattatcaatgtggtgaaaatggtagtaatttgtctggaggtcaaaaacaaaaaatagctttagctagagctctgattagaaataataaagtgtacttatttgacgaaatatcagctaatttagataatgataattcaaattccatacatgatattctgttcaatttaggtatttcatttattgaagtttcacatcattatgacttaaatgacaagagatacactgatatatataaattggaaaatggaacacttttcaaaattaagtga

SEQ ID NO: 113 - DNA, 1953 bp, Streptococcus pneumoniae
ggggtcatacttgtgaatcagagtaatgaaatatttttaaatacaatacaggaaaaaacacactataagaggtctatctcttcatcatttcaggaattaaaaaaatggaattctttgatatttaggagagggcgatattggtaccaatttgataattggagtatacccaatactggtgtaataaaggaatggtatgtcgaagataatgactggattcctaaggttagttcttccagtttagacaattcaaattcacttaaaattgtctttgatgtggaaaaatatactttgccagatgatagtatcttacaggatgttaggatttcatctgatgagagttatatagttttggttgtatcctcactgcgtacgactaatttaattggaataaaaaaatatactatggaagagttatttatcattgaagatatttcagtagaaagttcgttctatttgggtaaattcggtgttatgtatactcgctccaaagagtacgggaggccaagtaagttattctataaatcttttgatagctttacagaagaggaactgtttgaagaaaacgaatgctcttttcgattaaaaatagtccacattgatagcaataattgttttgtaaagtcagtagactttcagaaaggcaggatttttctatacagtttcgaccggacgggttttgttagacactcttacacagaaacggtagccccaacacctagagatatcgctctatttagtacagaaaaagcacagtactttcttgggctctcttcaactgaagaaaagaaagatcaactaattctaagggaaacttcttcgggagacagagtttctattactataccatatcaagatagggctagaagagttcactgtataggacgttatatccttttagactgttcaaacgcagcgaattccgtcttttatcttgctacatttaaaaataatagtttgagggagttgagtgttaataagataacatttgatgaaaagacaacactttatgaaaattcattttctgatcgtgttcttctgtttttagagaggagaactttttacgaaaaaatacttagttttgatttaatagaaaatacattaaaaactgaatttgaaagacccatcataaaatcgaataatactaaatatttttctaaggtgatttggactaaaaaagacagttatgatgtaagcataccgatttctttattttggaaaagtgaagatacggatgagctcccaagaagaaaaaaatgtattctaagtgtctatggggcttatggtaagaatgataattctgatttagatgaaattatgttatctataatagatgcaggttttatttatgctatagttcatgtaagaggtggaggctatttgggtggtgaatggtatcgctcaggaaaggcgttaaacaaatggaattctatcagagattttattgagggagtaaattatttaagggaaaatgatgtaattgacagtaagcgattaggtttaataacttctagtgcaggtggaataattgctggtgcggtgttgaacgaggaaaaaaatttattgcaaagcattctcttattttcgccatttataaatccttatgatacacttcagaatccaaatgatcctctttctaagaccgaaatagcagagtggggagatattagagaccctgaagtaaaggcttatataaagtcatattcgcctatgcaaaatattgaaaaggcacgagactcaaatactgttatagttaatattttgggtgagaaagacccatatattaataataacgaagtgatagagtggtcaaagaaattaaattctattggagttaaaagtttgttgtatttaaacaaagcagctggtcatggaggttttactccatcagatgttctcttaatgattgatactttaaattatttctttgaagaagtgggaaggaataacttatga

SEQ ID NO: 114 - DNA, 1449 bp, Streptococcus pneumoniae
aacgggggtgaccaagtgattgatgggaaacgattattatttagtttgaccatagtcagttatgccttgacgctagtaagtggaattgtgtatctgtttaataataataatgttagcttactttctactttattgttcttgttggttagtagcttaattgcttgttggaatgatatcaagtattacttaatccattttattttctatttaaccatttttgtatttctggtatcaagaccgaccattgattattttagggatggtgctttggatacctatcatccaatagcctatcgttttgcctttatagttgtcatgatttcgattctgggcttgaccacaggaggcattctggctcgttacttcatagctaggaagaaaataaaagtagcaaatataggaaattctctaaaagaggtttatatcaagcggttacgctttgtatcactaggagtttttcttctaacttatcctttctatttcattcggttatttgaacggctcttgtatcgtttgcagacttcctactatgcctactatgcaaattttgaaagtaaactgccttattttacctacattttgtctacctttacggtctatgcaatgtgtatgtatctggcaaccaagccaaagaaattgcaggccacagcagtgcttgtctcctttattgcagctaatactattcatttggcaattgggacacgaaatccctttattttaagtattttatttgcttttgtttattactttatgcgggagcaaactgaaaaaggaaaatggattgggtttaaagaaaagttagcgatttttgtaggttctcctattctcatgttagcgatgggagtactcaattatgtacgggataatgtccaagtttcccatacaggtttctgggatatcttacttgactttatctataaacaagggactagttttggtgttctggctcgaggttttctatttaacagtagcctcccttaccgagatttccgtaattttacttttggtcctgttcttgattattttgcaagggggagtttgggagccattttcggaggaaaagcctttgaacatacaaccaatagtgtggaactagctattgatagtaatagttatgcccacaatctatcctatcttgtcttgaacaaggaatacttgaaagggcatggtatcggaagtagttatatcatggagttgtataccgactatggtatgattggagtctttctgcttagtttcttactcggcgtattatttatagccatgctgcaagtagcctatcgctcaaggacaatcctatttgctttatccctactcatcttgaataatctattctttatgccaagaagcagcttttcagaaagtttcttcaatttatttacaatgcaattctggggaattgttcttgtgattatatttgtagcaaaaatgcttacaaaggaaaactag

SEQ ID NO: 115 - DNA, 831 bp, Streptococcus pneumoniae
tcaatgcaatcgaggaggaaagagatgaagaaaacaagctctaaactctttgtagtaccctacatgctttggattgcgctctttgtattggcacccttggtcttgattttcggtcaatcctttttcaacatcgaaggccagttcagtttagaaaattacaaatcttactttgcgtcacaaaacttgacctatcttaaaatgagtttcaactcagtgctttatgcaggcattgtgacctttgtggcactgcttatcagttatccgacggccctctttttgacccgtctcaaacaccgtcaactctggctcatgctgattatccttcctacctggatcaatttgctccttaaagcctatgcttttatcgggatttttggtcaaaatggctctattaaccaattcttggaatttatcggaattggttcacaacagttgctttttaccgatttttcctttatctttgtcgcaagctacatcgagctcccctttatgattttgccgattttcaatgtcttagacgatatggataataatctcatcaatgctagttatgaccttggtgcaactaagtgggagaccttccgtcatgtcatcttccctctatctatgaacggtgtgcgaagtggggttcagtcggtctttatcccaagtttgagtctcttcatgctgacccgtttgattggtgggaaccgcgttatcaccttggggacggctattgagcagaattttctaaccaatgacaactatggtatgggttcaaccatcggtgtgattctcatcctgaccatgttcatcaccatgtgggtgactaaggaaaggagagaacgatga

SEQ ID NO: 116 - DNA, 771 bp, Streptococcus pneumoniae
aaaggaaaccgtatgacagatgcgattttacaggtatcagacctgtccgtttattataataaaaagaaggctttgaatagtgtttccctatctttccaacctaaggaaattacagccttgattggtccatctggatcagggaagtcaaccctcctcaagtctctcaaccgcatgggagatctcaatccagaggtgaccacaactggatccgtggtgtacaatggtcacaacatctacagtccgcgtacagatacggttgaattacgtaaggaaatcggaatggttttccaacaacctaatcctttccctatgactatctatgagaatgttgtctacgggcttcgtatcaatggaattaaggataagcaggttctggatgaagccgtagaaaaagccttgcaaggtgcctctatctgggatgaggtcaaggatcgtctatatgattcagctattggattgtcaggtggtcaacagcagcgtgtctgcgtggcccgtgtcttggcaactagtcctaaaatcatcctcttggatgagccaacttcggctttggatccgatttcagctggtaaaattgaggaaaccttgtatggtctaaaagacaagtacaccatgcttctggtaacccgttccatgcagcaagcttcacgtatctctgataagacaggatttttcctagatggagatttgattgaatttaatgataccaagcagatgttccttgatccccaacacaaggaaacggaagactatattacaggaaaatttggataa

SEQ ID NO: 117 - DNA, 912 bp, Streptococcus pneumoniae
ttacgaaagaaagaggaaagaaaaattatgcgcgctaagaaattagataaacttgcaacagctgtcctctatacgattgctagcatcattgtgacaatcttggcttccttgattctctatatcttggttcggggcttgccccatatctcttggtctttcttgactggaaggtcttctgcttttcaagcaggtggtgggattggcattcagctttacaattcctttttcctattggtcattaccttgattatttctgtacctctttctatgggagctgggatttacttggctgaatatgctaaaaaaggtcctgttaccaactttgtgcggacttgtattgaaattttgtcctctttaccatcagtggtggtgggtctctttggttacttgatctttgtagtccagtttgagtatggattttcaatcatttcaggtgccttggccttgacagtctttaacttgcctcagatgacgcgtaatgtagaggatagtttgaaacacgttcaccatacccaacgtgaggctggtctggctcttgggatttctcgctgggagacagtggttcatgttgttattccggaagcgcttccaggtattgtaacgggtgtcgtcttggcatctggtcgtatctttggcgaagctgcagctctgatctatacagcagggcaatcggcgccagctcttgactggtctaactggaatatcctcagtgtgactagccccatctctatcttccgtcaagcagaaaccttggctgtccatatctggaaagtcaatagtgaaggcactattccagatggaaccattgtatcagcaggttctgccgctgtgctcctgatctttatcctgatttttaactttggagctcgtaagttcggaagctatctacacaagaaattaaccgctgcctaa

SEQ ID NO: 118 - DNA, 1800 bp, Streptococcus pneumoniae
gcgaatttatatctaaaagggatattaaagaaaggagatatgcttatgaagatttacaaaaaactatttgcttatgtccaagataagaaatatcttggggttttggccataattttttctgctatatctgctgcacttacagtatatggatattatttaatctacaaatttctagataagttaataattaattcaaacttatccggtgcagagagtatagcattaaaatctgttattacactaacaagtggagcgatattttattttgtctcaggaatgttttcacatatcttgggattcaggcttgaaacaaatttaagaaaaaggggaatcgatggtctggaaaaagcaagttttaggttctttgacttaaatccatctggtcaaataagaaagattatagatgacaatgctgcacaaactcatcaggtggtagcacacatgattcccgatagttctcaggcaataatcacacccgtacttgtacttgcacttggctttatagtaagtataagagttggcataattttgcttgctcttactataattggtggcttaattttaggggcaatgatgggcgagcaagaatttatgaagatataccaagaatccctatctaaactaagtgctgaaactgttgagtacgtgagaggaatgcaagttgtaaaaatatttaaagcaaatgtagagtcttttaaaagcttttataaggcgataaaagattactcaaagtatgcttatgattattccctatcttgtaaaaggccttatgttttgtatcaatggttattttttggactgattgcaattttaattattcctatagtttattttatgactagcttagctagcgcaaaggtgattttacttgagcttatcatgattttatttttatcaggagttctctttgtttcattcatgagaatgatgtggtactccatgtatatttctcaaggaaattatgcagtagatactttagaggcgctttacgaagatatgcaaaaagacaaattagtgcatggtaatgtcaataattttaaaaactataatatagaatttgagaatgttagctttgcttataatgataaagctgtcattgaaaatttatcctttaatttagaagaaggaaagtcctacgcacttgtcggttcatctggatcaggcaaatcaacagtagcaaaacttatatcaggtttttacaatgttaataaaggaagcataaagataggcgggatagcaataagtgaatattctgacgaagccttaattaaagccatttcctttgtttttcaagattcaaaattattcaagaagagcatttatgataatgtagcgttagctaataaagatgcgacgaaagatgacgttatgagagccttaaaattagcaggatgcgatttaatattagacaaattcccagaaagagaaaatacaatcataggctcaaaaggtgtttatttatccggtggagaaaaacaaagaattgcaattgctagagcaattttaaaggattccaaaattattattatggatgaagcatcagcatctattgacccagataacgagtttgaattgcaaaaagcttttaaaaatcttatgaaggataaaacagttatcatgattgcacacaggctatctacaattaaagaccttgatgaaattattgtcatggatagtggaaaaattatagaaagagggtctgacaaagaattaatgtcaaaagatacaaggtataagagcctgcaagagatgtttaacagtgcgaatgaatggagggtttcaaatgaaagagttttataa

SEQ ID NO: 119 - DNA, 1791 bp, Streptococcus pneumoniae
tgtcaaaagatacaaggtataagagcctgcaagagatgtttaacagtgcgaatgaatggagggtttcaaatgaaagagttttataaaaaaagatttgctcttacagatggaggagcaagaaatttaagtaaagcaacactggcttcatttttcgtttattgtataaacatgcttcctgccatattacttatgatttttgctcaggaagttttggaaaatatgggcaaaagcaatggcttttatatagtattctcagttttgattttgatagcaatgtatattttgctttctatcgaatacgataaattatataacacaacctatcaagaaagtgcagatttaagaataaggacagcggagaatttatcaaaattacctctatcttacttttctaaacatgacatttccgacatttcacaaacaatcatggctgatattgaaggcatagagcatgcaatgagccactcaataccaaaggtgggcggcatggtactgtttttcccattaatatctgtaatgatgctagcgggcaatgtcaagatgggtttagctgtaattattccatctattttaagctttatatttatacctttatctaaaaaatatcaggttaatggacagaatagatattatgatgtcttaagaaaaaactcagaaagctttcaagaaaatatcgaaatgcaaatggagattaaagcatataatttatcgaaggatattaaagatgacttatataaaaaaatggaagatagtgagaaagtacacttaaaggcggaagtaactacaattttaactttgtctatatcttcaatatttagctttatatctcttgctgttgtgatatttgtcggcgtaaatctaattattaataaagagataaattctctctaccttataggatatttactagctgctatgaagataaaagactctttagatgcatctaaagagggcttgatggaaatattttatttatcgcccaaaatagaaagattaaaagaaattcaaaatcaagatttacaagaaggcgatgactatagcttaaaaaaatttgatattgatctaaaagatgttgagtttgcctacaataaagacgcaaaagttttaaatggtgtaagttttaaagctaagcagggagaggtcactgctttggtaggtgcaagtggctgcggtaaaacaactatcttgaaacttatatcaagactttatgattatgacaagggacaaatcttaatcgatggcaaagatataaaggaaatatcaacagaatccctttttgataaggtgtctattgttttccaagatgtggttctctttaatcaaagcgttatggaaaatattagaatcggtaagcaagatgcaagtgacgaagaggttaaaagagcagcaaaacttgcaaattgcacagattttatagaaaaaatggataaaggtttcgatacagttattggtgaaaacggagctgagctatcaggaggagaaagacaaagattatcaatagccagagccttcttaaaagatgcgccgatattgatcttagatgagataacagcaagccttgatgttaacaacgagaaaaagattcaagagtctttaaataatttagttaaagataaaactgttgtaatcatttcacatagaatgaaatccatagaaaatgcagacaagatagtagttcttcaaaacggaagagtagaaagcgaaggtaagcatgaagagcttttacaaaaatcaaaaatttacaaaaatttaatagaaaagacaaaaatggcagaagaatttatttattag

SEQ ID NO: 120 - DNA, 675 bp, Streptococcus pneumoniae
aaaagacaaaaatggcagaagaatttatttattaggaggactacaatggataataaaaaattaaaagtaaaagatttagtaagcatcggtgtttttggcgtaatttattttgccttcatgtttggagttggtatgatgggcttgattccaatattgttcttaatatacccgacagtattagccatagttgcaggaactgttgttatgttatttatggctaaggttcaaaagccatgggcactatttatatttggtatgatatcaccacttgtgatgtttgcagctggtcatacctacgtagttgtggttttatcacttatagtaatgataatagcagaattaattagaaagattggtaattataattcatttaaatacaatatgctttcttatgcaatcttcagcacatggatatgtagctctttaatgcaaatgcttttagcaaaagaaaaatatatggagtggtctttgatgactatgggaaaagattatgttgatgtattagaaaagttaataacttatcctcacatggctttagtagccttaggtgctttcttaggaggaattcttggagcatatataggcaaggctctattgaaaaaacacttttcaaatggattatattgtgtgggatactttactccttgcctaattttatggtgctatctgaattaa

SEQ ID NO: 121 - DNA, 636 bp, Streptococcus pneumoniae
tgtattagaaaagttaataacttatcctcacatggctttagtagccttaggtgctttcttaggaggaattcttggagcatatataggcaaggctctattgaaaaaacacttttcaaatggattatattgtgtgggatactttactccttgcctaattttatggtgctatctgaattaaaccctatagttaagatgtttttgagtatacctattgttattagaatgtttattttaccatttatggcagcaagctttatgataaagacctcggatgtaggcgcaataatttcatcgatggataagcttaagatttcaaagaatgtatccatacctattgcggttatgtttagattcttcccatcttttaaggaggagaagaaaaacatcaaaatggctatgagagtaagagggataaattttaaaaacccagtcaaatatcttgaatatgtttctgtgccactactcattatatcatctaatatatcagatgacattgcaaaagcggcagaaacaaaggcaatagaaaatccaattgccaagaccagatacattcgcgtaaagatacagctaattgattttgtttatgttttagcggttgctggacttattgtgggaggcttaatatggttgaaataa

SEQ ID NO: 122 - DNA, 1173 bp, Streptococcus pneumoniae
ttttgtttatgttttagcggttgctggacttattgtgggaggcttaatatggttgaaataaaaaatttaagtcttgattatggtgaagagcatatattagatgatatatcactatccatagccgagggagagtgcgtgctatttacaggaaaaagtggaaatggtaagtcatctttaataaattcaatcaatggactagctgtaaggtatgataacgcaaagacaaagggcgaaataattattgatggtaagaatataaaaaatttggaactttatcaaatctcaatgcttgtttcaactgtttttcaaaatcctaagacatatttttttaatgtcaatacgacattagaattattattttatttggaaaatatcggtcttgcaagagaagagatggacaggcgtttgaaggatatacttgagatattcccgataaaaaatcttttgaacagaaatatatttaatctatccggcggtgaaaaacaaattctttgcattgcagcttcttatatagcaggtacaaagattatagttatggatgagccttcatcgaatttagatattaaaagcataagtgttttggcaaagatgctaaagatattaaaagagaaaggcataagcataattgttgcagagcatagaatttattatttgatggacatagttgaccgtgtatttttaatagataaaggaaagcttaaaaaaacttatactagaagtgaatttttaaagctagataaaaatgaattaaatgctttaagtttaagagataaagaattaagtaaattaaaagttccttatttaaaagaaggtggagagtatcagataaaaaatcttagttacaaatttactgatgatgagtgtttaagcttaaaagatatttcgttcaagcttgggaaaatttatggcataataggatccaacggacgaggaaaatcaacgcttttaagatgtttaataggtcttgagaaaaaatcaaaagaagaaatttattttaagggagagaagctatctaaaaaagaaagactcaaaaactcttcacttgttatgcaagatgtaaatcatcaattattcacagatgaagtattcaacgagcttagattaggagtaaagaattttgatgaagaaaaggcgaaaatcattttaaaccccaattattcaccccaaatctaa

SEQ ID NO: 123 - DNA, 276 bp, Streptococcus pneumoniae
tttgggttaaaagatttatgcctggacgaatttattgaaaggcatccgatgagtttatcaggagggcaaaagcaaaggcttgcaatagcatctgttatgtgcaagaattctccatttgtcttttttgacgaaccttcaagtggtatggattattccaatatgataaaaatatctgaactgattaataagtataaaaccatggataaaataatttttattgtttcccatgatatagaatttttaaatgaagtggcagatgaaatttttgaattgtaa

SEQ ID NO: 124 - DNA, 975 bp, Streptococcus pneumoniae
aaaggacgagagagctcaatggatattagaccgcaatcaagtgatgaacttgattcgcaaagaagagtaaggagagacatgtcaaatagtttaaaagggactttactaacagttgtggctggtattgcttgggggttgtcaggaacgagtggccaatacctaatggcacacggaatttcggctctggtcttgactaacttgcgtcttttaatcgctggtggaattctcatgctcttggcttatgctactgcaaaggataaaatactggtctttttaaaggatagaaagagtttgctgtctcttcttatttttgctctgattggtctttttctcaaccaattcgcctatctgtctgctattcaggagaccaatgcgggaacagcgacggtgcttcagtatgtttgtcctgtcggaattttaatttatagctgtatcaaggatagggtggcaccgacactgggagagatagtttccatcatattcgccatcggaggaaccttcctgatcgcaacacatgggcagttggaccagttatccatgacacctgctggtctgttctggggtctcttttctgccttgacttatgctctgtatatcattttacccatagccttgattaaaaagtgggggagcagcttggtcattggtgtgggaatggtcatagcaggtttggtcgcccttccttttacaggggttctacaggccgatatcccgactagtcttgattttctccttgcgtttgcaggcattatccttatcgggactgtctttgcctatacagctttccttaaaggagccagtctgataggaccggtcaagtcaagcttgttggcttcaattgagccaatatcggcgattttctttgccttcttaataatgaatgaacaattttatcccattgattttcttggtatggcaatgatattgtttgctgtaactttgatttctttgaaagatttattcttagaaaaataa

SEQ ID NO: 125 - DNA, 366 bp, Streptococcus pneumoniae
atatctcaaaacgcattatcgctgttttggtacctaatattgttgaagaaggcgaaactccacaggaagcctacgatttggaagccattatgtacaatccaaaaatcgtctctcactctgttcaagatgctgctcttggcgaaggagaaggttgcctgtctgttgaccgtaacgtgcctggctatgttgttcgccatgcccgcgttactgttgactactttgacaaagatggagaaaaacaccgtatcaaactcaaaggctacaactccattgttgttcagcatgaaattgaccacattaacggtatcatgttttacgatcgcatcaatgaaaaagacccatttgcagttaaagatggtttactga

SEQ ID NO: 126 - DNA, 261 bp, Streptococcus pneumoniae
gtttactctttaaaaaagatagaaatgagagaaatcatgctactgcaactattttctttatatttcgagagtttgatcttgaccaccatccttgttctgatttttttagggatttggattggtctgagagccatgtcgggagttgataagacagccagggctcgccaagcccatctctatgatatgattatgattggagtcttggttgtcccagtattatcctttgcggttatgagtttaattcttgttttcaaggcataa

SEQ ID NO: 127 - DNA, 579 bp, Streptococcus pneumoniae
gatgccagtagatggcgaacgcttggcctatcaaaaattaaagaaataatgcaaaagaagtatgtaaaaatcctctactcctcaccaattggtattctatcacttgtagctgatgaccattatttgtatggaatttgggttcaggagcagaagcattttgagaggggactaggagatgaaacgatagaagaagttgttagtcatcctattttagacccagttattgcttgcttagatgattactttaaaggcaagcctcaggatttatccaacttgctcttggcgccaatcggaacgaattttgaaaagagagtttgggactatttacagggcattccttatggtcagacagtgacctatggacaaattgctcaagacctgcaagtggcttctgctcaagcaattggtggagcagtgggacgcaatccttggtctatcctagtaccttgtcatcgtgtgttgggagcaggcaagcgtctgacaggttatgctgcaggagtggaaaagaaagcttggctcttggagcatgaaggagtagattttaaagatagaagcaatagaaggagaagcacatgttag

SEQ ID NO: 128 - DNA, 1455 bp, Streptococcus pneumoniae
aggaattgtggattgccaaattgtatcattgaaattattgctcaaatttgttatgatataaatatgaataaaagtagactaggacgtggcagacacgggaaaacgagacatgtattattggctttgattggtattttagcaatttctatttgcctattaggcggatttattgcttttaagatctaccagcaaaaaagttttgagcaaaagattgaatcgctcaaaaaagagaaagatgatcaattgagtgagggaaatcagaaggagcattttcgtcaggggcaagccgaagtgattgcctattatcctctccaaggggagaaagtgatttcctctgttagggagctgataaatcaagatgttaaggacaagctagaaagtaaggacaatcttgttttctactatacagagcaagaagagtcaggtttaaagggagtcgttaatcgtaatgtgaccaaacaaatctatgatttagttgcttttaagattgaagagactgaaaagaccagtctaggaaaggttcacttaacagaagatgggcaaccttttacacttgaccaactgttttcagatgctagtaaggctaaggaacagctgataaaagagttgacctccttcatagaggataaaaaaatagagcaagaccagagtgagcagattgtaaaaaacttctctgaccaagacttgtctgcatggaattttgattacaaggatagtcagattatcctttatccaagtcctgtggttgaaaatttagaagagatagccttgccagtatctgctttctttgatgttatccaatcttcgtacttactcgaaaaagatgcggccttgtaccaatcttactttgataagaaacatcaaaaagttgtcgctctaacctttgatgatggtccaaatccagcaacgaccccgcaggtattagagaccctagctaaatatgatattaaagcgactttctttgtgcttgggaaaaatgtttctgggaatgaggacttggtgaagaggataaaatctgaaggtcatgttgttggaaaccatagctggagccatccgattctctcgcaactctctcttgatgaagctaaaaagcagattactgatactgaggatgtgctaactaaagtgctgggttctagttctaaactcatgcgtccaccttatggtgctattacagatgatattcgcaatagcttggatttgagctttatcatgtgggatgtggatagtctggactggaagagtaaaaatgaagcatctattttgacagaaattcagtatcaagtagctaatggctctatcgttttgatgcatgatattcacagtccgacagtcaatgccttgccaagggtcattgagtatttgaaaaatcaaggttatacctttgtgaccataccagagatgctcaatactcgcctaaaagctcatgagctgtactatagtcgtgatgaataa

SEQ ID NO: 129 - DNA, 744 bp, Streptococcus pneumoniae
ctacggtttttatttgtatatggtagaatctttttacaaaaatacttggtaatcttgtttattcatgctataataggaacaattacttttaggaggtgcagtatgtcttatttatttgagatattaccgagtttactgaatggtgcgagcacgactgtacaggtctttgcactggtcttgctattttcgattcccttgggcgttttgattgcctttgccttgcaagtccattggaagcccctccattatctgattaacatttacatctgggttatgcgaggaacccccttactcttgcaactgatttttatctattatgtgctcccaagtattgggattcgtttagaccgccttcctgcagctattattgcctttgttctcaactatgcagcttactttgcagaaattttccgtgggggaattgacactattccaagaggacagtatgaggccgccaaggtcttgaagtttagcccttttgacagagtgcgctatattatcttgccccaagtgaccaagatcgttcttcctagtgtctttaatgaagttatgagtttggtcaaggatacttctttggtctatgctctcggaatttcagaccttatcttggctagtcgaacagctgctaaccgcgatgctagtctagttcctatgttcttggcaggagccatttatttgattttgattgggattgtgacaattatttccaaaaaagttgagaagaagtatagttattatagatag

SEQ ID NO: 130 - DNA, 717 bp, Streptococcus pneumoniae
atggaagaaagtattaatccaatcatctctattggtcctgttatcttcaatctgactatgttagccatgactttgttgattgtgggagttatttttgtctttatttattgggcaagccgcaatatgaccttgaaacccaaaggaaagcaaaatgtacttgagtatgtctatgactttgttattggatttacagaacctaacattggttcgcgctacatgaaagattactcactctttttcctttgtttattccttttcatggtgattgccaataaccttggcttaatgacaaagcttcaaacgatcgatgggactaactggtggagttcgccaaccgctaatttacagtatgacttaaccttatcttttcttgtcattttgttgacacatatagaaagcgttcgtcgtcgtggatttaaaaaaagtataaaatcttttatgagtcctgtttttgtcataccgatgaatatcttggaagaatttacaaacttcttatctttggctttgcggatttttgggaatatctttgcaggagaggtcatgacgagtttgttacttcttctttcccaccaagctatttattggtatccagtagcctttggagctaatttggcttggactgcattttctgtctttatttcctgcatccaagcttatgtttttactcttttgacatctgtgtatttagggaataagattaatattgaagaggaatag

SEQ ID NO: 131 - DNA, 1695 bp, Streptococcus pneumoniae
gatataatattatggattatcaacaaggaggaaaaacttttgagtgaaaagtcaagagaagaagagaaattaagctttaaagagcagattctgagagatttagaaaaagtaaaaggctatgatgaagttctgaaagaagatgaggcagtagttcgcactcctgcaaatgaaccttcaactgaagaactcatggctgattccttgtcaacggtagaggagattatgagaaaagctcctaccgtgcctactcacccaagtcaaggtgtaccagcttctccagcagatgagattcaaagagaaactcctggtgttccaagtcatccaagtcaagatgtaccttcttctccagcggaagaaagtggatcaagaccaggtccaggtcctgttagacctaagaaacttgaaagagaatacaatgaaaccccaacaagggtagctgtttcctatacgacggcagagaaaaaagcagaacaagcaggtccagaaacacctacgcctgctacagaaacagtggatatcatcagagatacatcacgtcgtagccgtagagaaggagcaaaacccgttaagcctaagaaagagaagaagtcacatgtgaaagcttttgtgatttcattccttgtattccttgccttgctctcagcaggtggttactttggttaccagtacgtgctagattccttattacctatcgatgctaattctaagaaatatgtgacggttggaattccagaaggttcaaacgttcaagaaatcggtacgacgcttgaaaaagctggtttggtaaagcatggtctgatttttagtttttatgccaagtataaaaattataccgacttgaaagcaggttactacaatttgcaaaagagtatgagtacagaagacttactcaaagagttgcaaaaaggtggaacagatgaaccgcaagaacctgtacttgcgactttgacaattccagaaggttataccttggatcagattgctcaagctgtgggtcaattgcaaggtgacttcaaagagtctttgacagcggaggctttcttggctaaagttcaagatgagacgtttatcagtcaagcagtagcgaaatatcctactttactggaaagtttgcctgtaaaagacagcggtgcgcgttatcgtttggaaggataccttttcccagctacatactctatcaaggaaagcacaactattgagagcttgattgatgagatgttagctgctatggataagaacctatctccttactatagtactatcaaatctaaaaacttgactgtcaatgagttgttgaccattgcttccttggtcgaaaaagaaggtgccaagacagaagatcgtaagctcattgcaggtgtattctacaatcgtttgaatcgtgatatgccacttcaaagtaatattgcaatcttgtatgcccaaggaaaactggggcaaaatatcagtctagctgaggatgttgcgattgataccaacattgattcaccttataatgtttataaaaatgtaggtctcatgcctggtccagtcgatagtccaagtctggatgcgattgagtcaagcatcaatcaaactaagagcgataacctctactttgtagcagatgtcacagaaggcaaggtctactatgctaacaatcaagaagaccacgaccgcaatgtcgctgaacatgtcaacagcaaattaaactaa

SEQ ID NO: 132 - DNA, 879 bp, Streptococcus pneumoniae
tcgtcgtttacaggaggaaatttaacagggcaattgactgaaaagattcaagaacatgaattaattaagactaaccaagcagagaaaagtgtacaggatgttttggataattgtattgaaagggtacaaaacaattcactgaaatcagatagggttacttcttttgagaccccgtttgctctcttatttatctttgcgactatagctgtgatgctaacctatgggggttatcgggtcagcgcaggatatatatctgtgggaaccttggtttcgtttttgatttacctctttcaattacttaatcctattagtaatatagctaattttgtaactgtttattctaggagcaagggatcttcagttgcactggagaacttgcttgcagttcctaaagaaaaatttgagggaggaaaatcggtatcaggacgagggttgaattttaaccatgtctattttggttatgatgaaaatcgacctgtcttaaaggatattacttgttcaattttcaaggggcaaaaaattgcttttgttggaccatctggatcaggaaaatcaacgattgtgcgtttgttagagcggttttataaaccgctttcaggagatattctaatggagcaatcaagtatatatgattttaacttaaaagaatggagaagtaaaatcgcttgggtttcacaaaataatgcagtcttatctggcagtattcgtgacaatctttgtctcggtttgaatcgcttagtaactgatgatgaattgatgaaagtgctagacttagtatcactaggtgatgagattcgctccatgaaagagggactagatactgaagttggtgaacgcggacgactcttgtcaggggggcgaacgaaagacttcaaatag

SEQ ID NO: 133 - DNA, 555 bp, Streptococcus pneumoniae
ggagtatttatgaaattaaaattattaagagtagatactaaggtgattatggggagtttcttacttgttctgtctagtctacttgctttgttgcttccccttatcttaaaggatttaatagatgggagttctattgaaaatataggctccaaagtatttcaatcgtttttgatttttattggtcaagccttgttttcttctattggttactatctgtttagtcaatcgggtgaaaaaaagatagcaaaaatcaggaaaaaagtgatagaggggttgatttatgtagagaaatccttctttgataagagccaaagtggggagttgacttctgccattgtcaatgacacgagtgtcattcgtgagtttttaattacgactttcccaaatattattctgagtttagttatggtacttggttccattgtagtcttatttagtcttgattggaatctttctctacttttattcatcactcttccttgtatgatgtttattatcttgcccctttccaatatcagtgaaaagtatagtcgtcgtttacaggaggaaatttaa

SEQ ID NO: 134 - DNA, 1989 bp, Streptococcus pneumoniae
aacaaatatttaaagcaggaggttccggaaatgaaaaagtctaagagcaaatatctaaccttggcaggtcttgtcctgggtacaggagttttattgagcgcgtgtggaaattctagcacggcgtcaaaaacctacaactatgtttattcaagtgatccatctagcttgaactatctagcagaaaaccgcgcagcaacatccgatattgttgcaaatttggtagacgggttattagaaaatgaccaatatgggaatattattccatcattagcagaggattggactgtttctcaggacggtttgacctatacctacaaacttcgtaaggatgccaagtggtttacttctgagggagaagaatatgcgcctgtaactgcccaggattttgtgacaggtttgcaatatgcagctgataaaaaatcagaagccttgtatctagtgcaggactctgttgctggtttggatgactatatcactggtaaaacaagcgacttttcaactgtcggtgtcaaggcacttgatgaccaaacggttcaatatactttggttaaaccagaactttactggaattcaaaaacacttgcaacgatactttttcctgttaatgcagatttcctgaaatcaaaaggggatgattttgggaaggcggatccatctagtattttgtacaatggacctttcttgatgaaagcacttgtctcaaaatctgctattgaatataagaaaaaccctaattactgggatgctaagaatgtctttgtagacgatgtgaaattgacctactatgatggtagcgaccaagaatcactggaacgtaattttacagctggtgcttatactacggctcgtctttttcctaacagctccagctatgaagggattaaagaaaaatacaaaaacaatatcatctatagtatgcaaaattcaacttcatatttctttaattttaacctagataggaagtcttacaattatacttctaaaacaagtgacattgaaaagaaatcgactcaggaagcagttctcaataaaaacttccgtcaggctatcaattttgcttttgacagaacatcttatggggctcagtctgaagggaaagaaggtgcaacaaagattttgcgtaacctagtggttcctccaaactttgtcagtatcaagggaaaagactttggtgaagttgtagcctctaagatggtcaactatggtaaggaatggcaaggtatcaactttgcggatggtcaagacccttactacaatcctgagaaagccaaggctaagtttgcggaagctaagaaagaactcgaagcaaagggtgttcaattcccaatccacttggataagactgtggaagtaacagataaagtaggcatacaaggagttagttctatcaaacaatcaattgaatctgttttaggttctgataatgtagtgattgacattcagcaattaacatcagatgagtttgacagttcaggctactttgctcaaacagctgctcagaaagattatgatttatatcatggcggttggggacctgattatcaagacccgtcaacctatctcgatatttttaatactaatagtggaggatttctgcaaaatcttggactagagcctggtgaggccaatgacaaggctaaggcagttggactggatgtctatactcaaatgttggaagaagctaataaagagcaagatccggccaaacgttatgagaaatatgctgatattcaagcttggttgattgatagttctttagttcttccaagtgtttcgcgtgggggaacaccatcattgagaagaaccgtaccatttgctgctgcctatggtttaaccggtacaaaaggggttgaatcatataaatacctcaaagtacaagataagattgtcacaacagacgaatatgcaaaagccagagaaaaatggttgaaagaaaaagaagaatccaataaaaaagcccaagaagaattggcaaaacatgtcaaataa

SEQ ID NO: 135 - DNA, 1647 bp, Streptococcus pneumoniae
ttatcaaaattgaatgaggaatctatgtcgcacgaaaacaatcaccagcaggcccagatgttacgggggactgcttggctaacggctagtaactttatcagtcgcctactcggggctgtttacattatcccttggtacatctggatgggggcttatgcagctaaggcaaatggtctctttaccatgggttacaatatctatgcttggttcttgttggtttcaacagcggggattccagttgcggtggccaagcaagttgccaagtataataccatgcgagaagaagagcatagctttgccctgattcggagcttcttaggctttatgacaggactaggcctggtttttgctttagtcttgtatgtctttgctccttggctagcagacttgtctggcgtgggcaaagacttgatcccaatcatgcaaagcttggcttggggagtcttgattttcccgtctatgagtgttatccgaggatttttccaagggatgaataacctcaaaccctatgccatgagccaaattgctgagcaggtcattcgtgttatctggatgctcctagcaacctttatcattatgaagctcggttcaggagattatctagcagccgttacccaatcaacctttgctgcctttgtcggtatggtagccagttttgcagtcttgatttatttccttgcccaagaaggttcactcaaaagaatctttgaaacaggagataagattaacagtaagcgtctcttggttgataccattaaggaagccattccttttatcctgacagggtctgccatccagctcttccagattttggatcagctgacctttatcaatagtatgagctggtttaccaactacagcaatgaggacttggttgtcatgttttcttatttctcagccaatcctaataaaatcacgatgattttgatttctgtaggggtttcgattgggagtgttggtttgccacttttgacggaaaactatgtcaagggggacttgaaagcagcttctcgtctcgttcaggacagtctcaccctactctttatgttcttgctaccagcaacggttggagtggttatggtaggagaacctctttatacggtcttctatggtaagccagatagtttggctctgggcttatttgtctttgcagttttgcagtctattattttaggcttgtacatggtcttgtctccaatgcttcaggccatgttccgcaaccgcaaggccgttctctattttatctatggttctattgccaagctagtcttgcaactacctaccatcgccctcttccacagttatggtcctttgatttcaacaaccattgctctcatcattcctaacgtcttgatgtatcgggatatttgtaaagtaactggtgtcaagcgcaaggtgattttgaagcgaaccattttaatcagtttgctgaccctagtcatgtttctgttaataggaaccatccagtggctgttaggatttttcttccaaccaagtggacgtttgtggagcttcttttatgtagctcttgtcggtgccatggggggtggactttatatggttatgagtctgcgtacctatttattagataaggtaataggaaaagcccaagcagatcgcctgcgagcaaaatttaagctttcgtaa

SEQ ID NO: 136 - DNA, 639 bp, Streptococcus pneumoniae
gcaaatttcttgcaagttcttttgttttgttgtaatatattttataacaacgagagagttctcgaaattttaagaaaaaggagacacatcatgtctaaaaaagtattatttatcgtcggatcactacgtcaaggttctttcaaccaccaaatggcgctcgaagctgagaaagcacttgctggtaaagcggaagttagctaccttgattattcagcccttcctctcttcagccaagatttggaagttccaacacatccagctgtagctgctgctcgtgaagcagttctcgttgcggatgctatctggattttctctccagtctacaacttctctatccctggtacagtgaaaaacttgcttgactggctatctcgtgcccttgacttgtctgatacacgtggcgtttctgcccttcaagacaagtttgtcacagtatcatctgtagccaatgcagggcacgatcaacttttcgctatctacaaagacctcttgccatttatccgtacacaaggcgttggtgatttcactgctgcacgtgttaatgactctgcctgggcagacggaaaattggttcttgaagaaacagtcctaaactcacttgaaaaacaagctcaagacttggtcgaagctatcaagtaa

SEQ ID NO: 137 - DNA, 1902 bp, Streptococcus pneumoniae
agccatccatgcttacctgagggagaaaaaatgagtgattttatcgttgaaaaactaagtaaatccgttggtgacaagaccgtttttagggatatttcctttattatccatgacttagacagaattggtttaatcggtgtcaatgggactggcaagaccacccttttggacgtcctttctggtgtttctggatttgatggggatgtcagtcctttttcagctaaaaatgattaccagattggttacttgactcaggatcctgattttgatgatagaaagacagttttggatacggttctatctagtgaactcaaggaaatccagctcattcgtgagtatgaattgattatgctcgactatagtgaggacaagcaggcgcgtttggaacgtgtcatggcagagatggactctctccaagcttgggaaatcgaaagtcaggtcaagaccgttcttagcaaattgggcattcaagacttatctactcctgttggggaattgtcaggtggtctgagaagacgggtacagttggcacaagtcttacttggcaaccacgacctcttgcttttggatgagccgaccaaccatctggatattgcgattattgagtggctgaccctctttttgaaaaattctaagaagaccgtcctttttatcactcacgatcgttatttcttagacgctttgtcaacacggattttcgagttggatcgtgcaggcttgaccgagtaccagggaaattaccaggactatgttcgcctaaaggcggaacaggatgagcgcgacgcggctcttcttcacaaaaaagaacaactctacaaacaagaattggcctggatgcgcagacaaccgcaggcgcgtgcgaccaagcaacaagctcgtatcaatcgtttccatgatctgaaaaaggaagtttcaggcagtagtgctgagacagacttgactatgaactttgaaaccagtcggattgggaagaaagtcatcgagtttcaggatgtttcctttgcctatgaaaataagcccattttgcaaaattttaatctcttagttcaggctaaagaccgtattggaattgttggggacaatggtgttggaaaatcaaccctacttaacctgattgcaggaagtcttgagccgacagcaggacaagttgtgattggggaaactgttcgcatcgcctatttctctcaacaaattgagggtttggatgaaagcaagcgtgtgatcaattacctgcaggaagtggcagaggaggtcaagaccagtggtggttctacgacttccatcgctgagttgctggagcaattcctcttcccacgttcgacgcatgggactttgattgagaaattgtcagggggtgagaaaaaacgtctttatctcctcaaactgcttttggaaaaaccaaatgttcttcttttagacgagccaaccaatgacctagatattgcaactttgacagtcttagagaatttcttgcaaggttttgcaggtcccgttttaacagtcagtcacgaccgctatttcttggataaggtagcgaccaagattctcgcttttgaggatggcaagattcgtcctttctttggtcattacaccgactatcttgatgaaaaagcttttgaaacagatatggccaatcaagtgcaaaaggccgaaaaggaaaaagtggtcaaggttcgagaagacaagaaacgcatgacctaccaagaaaagcaggagtgggcaagtattgaaggtgatattgaaaccttggaaaaacgtatcgctgctattgaagaggaaatgcaggctaacggctctgactttggtaagctggctactctccaaaaagaattggatgagaaaaatgaagcactccttgaaaaatacgaacgctatgagtatctcagtgaatttgatagttaa

SEQ ID NO: 138 - DNA, 579 bp, Streptococcus pneumoniae
tatactaaggtagtaatcattaagaagtggttacaaaaaataatgaatgaggtaaagaaaatggtagaattgaaaaaagaagcagtaaaagacgtaacatcattgacaaaagcagcgccagtagcattggcaaaaacaaaggaagtcttgaaccaagctgttgctgatttgtatgtagctcacgttgctttgcaccaagtgcactggtatatgcatggtcgtggtttccttgtatggcatccaaaaatggatgagtacatggaagctcttgacggtcaattggatgaaatcagtgaacgcttgattacactcggtggaagcccattctctacattgacagagttccttcaaaatagtgaaatcgaagaagaagctggtgaataccgtaatgttgaagaaagcttggaacgtgttcttgttatctaccgttacttgtcagaacttttccaaaaaggtttggatgtcactgatgaagaaggtgacgatgtgacaaacggtatctttgcaggcgctaaaactgaaacagataaaacaatttggatgcttgcagccgaacttggacaagcacctggtttgtaa

SEQ ID NO: 139 - DNA, 1083 bp, Streptococcus pneumoniae
tctagcaatcttttgtttgggcttatcggctgcatttatggggcgtttggtagaaaaatttggtccgaaagtcatgggaagtctatctgcttttctatacgcaggtggaaatatcttaacaggatttgcaatagaccgtcagagctgtggttgttgtatctcgcttatggcattttaggtgggcttggtttgggagcaggctatattacccctgtgtcgacgattataaaatggtttcctgataaacgtggtctcgcaacaggtttagcgattatggggtttggttttgcttctttattgactagtcccatagcgcaacacctcatcgcaggggtagggcttgtagaaactttttatattttaggagcaagttactttattatcatgctcctagcttcacaattcattaagcgtccaaatgagcaagagcttgcaattttatcttcttcagggaaagaaaaaacagcctctttgacgcaaggaatggctgcaaatcaggctctaaaaagcaatcggttttatatgctttggattattttctttatcaacatagcttgtggtttaggcttaatttcagcggcatcgccaatggcacaggagatggctggcttgtctacaagtcatgcagcagtaatggtgggtgttttggggattttcaatggatttggtcgcttgctctgggcgagtttgtctgactatatcggtcgccctctaacctttagtatattactgcttgtcaatcttttcttttctctctcactttggctctttacagattccgttttatttgtagttgctatgtctattttgatgacttgctatggagctggtttttctttgattccagcttatctcagtgatatttttggaaccaaggaattggccgctctgcatggttatattttaacagcttgggcaatggctggtttagcgggacctattttattagcagagacttataaaatggctcattcgtacacacaaaccttgttcgtttttctcattttatacagtatcgccttggctttgtcttattatctaggtcgttcaatcaaaaaagaaagtcaaaaagcgcttacatga

SEQ ID NO: 140 - DNA, 468 bp, Streptococcus pneumoniae
gacaatatgaagcaaacaaaaacaactaaaatcgcccttgtatccctattaaccgccctttctgtggttctaggttatttcttaaaaatcccaacacctacaggaattctaactcttttagatgctggtgtcttctttgcggccttttactttggtagtcgtgaaggagcggtagtcggaggactagcaagtttcttgattgacctcttatcaggctaccctcagtggatgttctttagcttggtcaaccatggcttgcagggatttttcgcaggatttaaaggaaaaagtcagtggttaggccttattttagcaactattgccatggtaggaggctacgccttgggttctgctttgatgaatggctgggcagcagccctcccagaaattctaccgaattttatgcaaaatatggtagggatgattgtaggatttattcttagtcaaagtatcaagaagattaagtaa

SEQ ID NO: 141 - DNA, 684 bp, Streptococcus pneumoniae
gagaagatgatttcaaagagattagaattggtagcttcctttgtgtcacagggggctattttactagatgtgggaagtgaccatgcttatctgcctatcgagttggttgagagaggccaaatcaaaagcgctattgcaggtgaggtggtggaaggtccctatcagtctgcggttaaaaatgttgaggctcacggcctaaaggagaaaatccaagtccgtttagccaatggcttggcagcttttgaagagactgaccaagtgtctgtcattaccattgctggcatgggtggtcgtttgattgctaggattttagaagaaggtttggggaagttagctaatgtagagcgtttgatcctccagcccaataatcgtgaagacgacttgcgtatctggctacaggatcatggattccagattgtagcagaaagcatcttagaagaagctggaaagttttatgagattttggtggtggaagcaggacaaatgaagctatcagccagtgatgttcgctttggtcccttcttgtccaaagaagtcagtccagtatttgtccaaaaatggcaaaaagaagctgagaagctagagttcgccctcggacaaatcccagaaaaaaatctggaagaacgtcaagttctagtagataagattcaagctatcaaggaggtgctccatgttagcaagtga

SEQ ID NO: 142 - DNA, 336 bp, Streptococcus pneumoniae
gaaaaaattttggagggtatccgtatgaaaattgttggtgttgcagcttgtactgtgggaattgcccacacttatattgcacaggaaaaattagagaatgccgcaaaggtagctggacatgtgattcatgttgagactcaggggacaataggggtagaaaatgaattgagtcaagagcagattgatgcagcggatgtagttattttagcagttgatgttaagatttctggtatggaacgctttgagggtaaaaagattatcaaggttccaacagaagtggcagtcaaatctcccaataaactgattgctaaagctgttgagattgttacgaaataa

SEQ ID NO: 143 - DNA, 777 bp, Streptococcus pneumoniae
cttgacttaattttttttttaatgtatattaagagacaggaggaatacaagtttatgatacgtatcgaaaacctcagtgtctcctacaaagaaacgttggcacttaaggatatttcactagtgctccatggaccaacaattaccggcatcattggtccaaacggcgctgggaaatcaacactattaaaaggtatgttgggaattatcccacatcaaggtcaggcatttctcgatgacaaggaagttaaaaaatccttacaccgaattgcctatgtcgaacaaaaaatcaatatcgactacaactttcccatcaaggtcaaggaatgcgtctcgttaggactatttccctctattcctctctttcgaagtttaaaggctaaacattggaagaaagtgcaagaggcccttgaaatcgtcggcctagctgactacgctgaacgtcaaattagtcaactgtctggaggtcaattccagcgggtcttgattgccagatgtttggtgcaggaagccgactatatcctcttggatgaaccctttgctgggattgactctgtcagtgaggaaatcatcatgaatacgctgagagatttgaaaaaagctgggaagacggttctcatcgttcaccacgacctcagcaagattccccactacttcgatcaagtcttacttgtcaatcgagaagtgattgcctttggtccaacaaaagaaacttttaccgaaaccaatctaaaagaagcttacggtaatcaactctttttcaatggaggtgacctatga

SEQ ID NO: 144 - DNA, 897 bp, Streptococcus pneumoniae
aaggaggtatttatgacatattacgttgcaattgatatcggtggaaccaacatcaagtatggtttggttgatcaagaggggcaacttcttgaatcgcatgaaatgccaactgaggcgcataagggtggacctcatatcttacaaaagaccaaagatatcgtagctagttatttagaaaaaggcccagtagcaggtgttgccatatcttctgctgggatggtggatccggataagggtgagattttctatgctgggccgcaaatccctaactacgcaggcacccagttcaaaaaggaaatcgaagaaagctttactattccttgtgagattgaaaatgatgtcaactgtgcaggtcttgctgaggcagtatctggttcaggcaagggagcaagtgtgacactttgcttgaccattggaaccggtatcggtggttgcttgattatggataggaaagtcttccatggttttagcaattcagcctgtgaagtcgggtatatgcatatgcaggatggagcttttcaagacttggcttctacaacagctttagtgaaatatgtagctgaagcccatggagaagatgttgatcagtggaatggccgtagaattttcaaagaagccactgaaggaaacaaaatctgcatggaaggtattgaccgtatggttgactatctaggaaaaggtctggcaaatatttgctacgttgccaatccagaagtggttattcttggtggtggtatcatggggcaagaggctatcctcaaacctaagatccgtacagccttgaaagaggctttggtaccaagtttagcagaaaaaacacgattagaatttgcccatcaccaaaatacagcagggatgttgggtgcatattatcattttaagacaaaacaatcctag

SEQ ID NO: 145 - DNA, 690 bp, Streptococcus pneumoniae
caaaaaagaaaacagtttacaaagaaaaatgatggaggagcaaacatggcacaaaaaggagtaagccttatcaaggcagcatttgatacagataactttctcatgcgttttagtgagaaggtcttggacatcgtgacagccaatcttctttttgtcgtctcttgtttacccatcgtgacgattggagtggctaaaatcagcctctacgagaccatgttcgaagttaagaagagcagacgggtgcctgtttttaaaatctatctaagatctttcaagcaaaatctgaaactaggtcttcagctgggtttaatggagttaggaattgtgtttcttaccctttcagatctctatcttttctggggtcaaacagctctgcccttccaattgctgaaagccatttgtttaggtattctgatttttcttactatcgtgatgctggctagttaccctatcgcggcacgttatgacctatcttggaaagaaattcttcaaaaaggattgatgttggctagttttaactttccttggttcttcctcatgttagccattcttgtcctcattgtgatggttctttatctgtccgccttcagtctactcttaggtggctcagtcttcctactttttgggtttggactattggtctttatccagactggattgatggagaaaattttcgcaaaataccaatag

SEQ ID NO: 146 - DNA, 915 bp, Streptococcus pneumoniae
cccaatcttgtaaaagaagggagaaggagaatggttaaagaacgtaatttaactcgctggatatttgttttgccagctatgattatcgtaggattactctttgtttatccgtttttctcgagtattttttatagctttaccaataagcatttgattatgcctaattataaatttgttggtttggctaactataaagctgtgctatcagatcccaacttctttaatgcgttctttaattcaattaagtggaccgttttctcattagttggtcaagttttagtagggtttgtattggctttagctcttcacagagtacgccacttcaagaaattatataggacattattgattgttccttgggcatttcctaccatcgttattgccttctcttggcagtggattctaaacggggtttatggctacttacctaatctaatcgtaaaattaggtttaatggaacatacacctgcatttttgacagatagtacatgggcattcctatgtttggtgtttatcaacatttggtttggagcaccaatgattatggttaatgtgctttcagctttgcaaacagtaccagaagaacaatttgaggctgctaagatagatggtgcttcaagttggcaggtgttcaagtttatcgtctttccacatattaaagtggttgtaggacttctagttgttttgagaactgtatggatctttaataactttgacattatctacctcattactggtggtggaccagccaatgctacaacgacgcttccaatttttgcttacaacctgggctggggaactaaattgttgggtcgtgcttcagcagttacagtactgctctttatcttcttggtggcgatttgctttatctactttgctatcatcagtaagtgggaaaaggagggtagaaaataa

SEQ ID NO: 147 - DNA, 1356 bp, Streptococcus pneumoniae
tgtagaaagagaagaacgatgaaaaaaatgagaaagtttttatgtctagctggaattgcgctagcggctgttgccttggtagcttgttcaggaaaaaaagaagctacaactagtactgaaccaccaacagaattatctggtgagattacaatgtggcactcctttactcaaggaccccgtttagaaagtattcaaaaatcagcagatgctttcatgcaaaagcatccaaaaacgaaaatcaagattgaaacattttcttggaatgacttctatactaaatggactacaggtttagcaaatggaaatgtgccagatatcagtacagctcttcctaaccaagtaatggaaatggtcaactcagatgctttggttccgctaaatgattctatcaagcgtattggacaagataaatttaacgaaactgccttaaatgaagcaaaaatcggagatgattactactctgttcctctttattcacatgcacaagtcatgtgggttagaacagatttgttaaaagaacataatattgaggttcctaaaacttgggatcaactctatgaagcttctaaaaaattgaaagaagctggagtttatggcttgtctgttccgtttggaacaaatgacttaatggcaacacgtttcttgaacttctacgtacgtagtggtggaggaagcctcttaacaaaagatcttaaagcagacttgacaagccaacttgctcaagatggtattaaatactgggttaaattgtataaagaaatctcacctcaagattctttgaactttaatgtccttcaacaagctaccttgttctatcaaggaaaaacagcatttgactttaactctggcttccatatcggaggaattaatgccaacagtcctcaattgattgattcgattgatgcttatcctattccaaaaatcaaagagtctgataaagaccaaggaattgaaacctcaaacattccaatggttgtttggaaaaattcaaaacatccagaagttgctaaagcattcttagaagcactttataatgaagaagactacgttaaattccttgattcaactccagtaggtatgttgccaactattaaggggattagcgattctgcagcctataaagaaaatgaaactcgtaagaaatttaaacatgctgaagaagtaattactgaagctgttaaaaaaggtactgctattggttatgaaaatgggccaagtgtacaagctggtatgttgactaaccaacacattattgaacaaatgttccaagatatcattacaaatggaacagatcctatgaaagcagcaaaagaagcagaaaaacaattaaatgatttatttgaggctgttcagtag

SEQ ID NO: 148 - DNA, 2403 bp, Streptococcus pneumoniae
atgtcttatttcagaaatcgggatatagatatagagaggatcagtatgaatcggagtgttcaagaacgtaagtgtcgttatagcattaggaaactatcggtaggagcggtttctatgattgtaggagcagtggtatttggaacgtctcctgttttagctcaagaaggggcaagtgagcaacctctggcaaatgaaactcaactttcgggggagagctcaaccctaactgatacagaaaagagccagccttcttcagagactgaactttctggcaataagcaagaacaagaaaggaaagataagcaagaagaaaaaattccaagagattactatgcacgagatttggaaaatgtcgaaacagtgatagaaaaagaagatgttgaaaccaatgcttcaaatggtcagagagttgatttatcaagtgaactagataaactaaagaaacttgaaaacgcaacagttcacatggagtttaagccagatgccaaggccccagcattctataatctcttttctgtgtcaagtgctactaaaaaagatgagtacttcactatggcagtttacaataatactgctactctagaggggcgtggttcggatgggaaacagttttacaataattacaacgatgcacccttaaaagttaaaccaggtcagtggaattctgtgactttcacagttgaaaaaccgacagcagaactacctaaaggccgagtgcgcctctacgtaaacggggtattatctcgaacaagtctgagatctggcaatttcattaaagatatgccagatgtaacgcatgtgcaaatcggagcaaccaagcgtgccaacaatacggtttgggggtcaaatctacagattcggaatctcactgtgtataatcgtgctttaacaccagaagaggtacaaaaacgtagtcaactttttaaacgctcagatttagaaaaaaaactacctgaaggagcggctttaacagagaaaacggacatattcgaaagcgggcgtaacggtaacccaaataaagatggaatcaagagttatcgtattccagcacttctcaagacagataaaggaactttgatcgcaggtgcagatgaacgccgtctccattcgagtgactggggtgatatcggtatggtcatcagacgtagtgaagataatggtaaaacttggggtgaccgagtaaccattaccaacttacgtgacaatccaaaagcttctgacccatcgatcggttcaccagtgaatatcgatatggtgttggttcaagatcctgaaaccaaacgaatcttttctatctatgacatgttcccagaagggaagggaatctttggaatgtcttcacaaaaagaagaagcctacaaaaaaatcgatggaaaaacctatcaaatcctctaccgtgaaggagaaaagggagcttataccattcgagaaaatggtactgtctatacaccagatggtaaggcgacagactatcgcgttgttgtagatcctgttaaaccagcctatagcgacaagggtgatctatacaagggtgaccaattactaggaaatatctacttcacaacaaacaaaacttctccatttagaattgccaaggatagctatctatggatgtcctacagtgatgacgacgggaagacatggtcagctcctcaagatattactccgatggtcaaagccgattggatgaaattcttgggtgtaggtcctggaacaggaattgtacttcggaatgggcctcacaagggacggattttgataccggtttatacgactaataatgtatctcacttagatggctcgcaatcttctcgtgtcatctattcagatgatcatggaaaaacttggcatgctggagaagcggtcaacgataaccgtcaggtagacggtcaaaagatccactcttctacgatgaacaatagacgtgcgcaaaatacagaatcaacggtggtacaactaaacaatggagatgttaaactctttatgcgtggtttgactggagatcttcaggttgctacaagtaaagacggaggagtgacttgggagaaggatatcaaacgttatccacaggttaaagatgtctatgttcaaatgtctgctatccatacgatgcacgaaggaaaagaatacatcatcctcagtaatgcaggtggaccgaaacgtgaaaatgggatggtccacttggcacgtgtcgaagaaaatggtgagttgacttggctcaaacacaatccaattcaaaaaggagagtttgcctataattcgctccaagaattaggaaatggggagtatggcatcttgtatgaacatactgaaaaaggacaaaatgcctataccctatcatttagaaaatttaattgggaatttttgagcaaaaatctgatttctcctaccgaagcgaactag

SEQ ID NO: 149 - DNA, 636 bp, Streptococcus pneumoniae
acgatgagacttgaaattataaatggacagaaaatttatgggaaaagacctattttaaatcagttgaatttggtgtttcaatcaggaaaaatttatggacttaaaggtgataatggatctggcaagacggttcttttaaagatacttgctggttatattaagcttgacaaaggaaaagttcttcaagatggtaaagtttacggggtaaaaaatcattatattcaggatgcaggaattttaattgaaaaagtcgagtttttatctcatttatccctgagagaaaatttggaactgttaaggtatttttcatctaaagttacggaaaaaagaattgcctattggattcaatactatgatttacaggaatttgaagacattgaataccgtcatttatccttaggaacaaagcaaaaaatggccttgattcaagcctttatttcctctccttctatactctttctcgatgaacctatgaatgctttggatgagaagagtgtgaggttaaccaaacaggtcattttatcttacctgaaaaaagaaaatggtctggttatcctgacgtcgcacatatcggaagatatttcagacctttgtacagatgtattagttgtcgaaaatggacatatacaaatgtaa

SEQ ID NO: 150 - DNA, 297 bp, Streptococcus pneumoniae
cggatgcgttccatgacccgtctggcttcccaggtttcgtcatttccatgtttcactttcgcaaaatgcttctccaaatcttcaaagttgaagttggatgtgaaaaaggtcggtaaattttcctgcatccgatattggagaatgacctgcaggatttcgtcacgcacccaaacggttgattgctcggcgccaatatcatctaaaatcaggacctcagacagcttaatctcatccaccaaggtcttaacattgccatcactgatagcatttttgacatcaatgacaaagctaggatag

SEQ ID NO: 151 - DNA, 1509 bp, Streptococcus pneumoniae
tcagtgattatattaaaggagtttaagcctatgtcattactagtatttgaaaatgtatccaaatcatatggagcaacaccagcccttgaaaatgtttctcttgacattccagctggaaaaattgtcggccttcttgggccaaacggctcaggaaaaacaaccctgattaaactaattaatggcctcttacaaccagatcaaggacgtgtcctcatcaacgacatggacccaagcccagcaaccaaggccgttgtagcttatttgcctgatacgacctatctcaatgagcaaatgaaggtcaaagaagccctaacctacttcaagaccttctataaagatttcaatcttgaacgcgcccatcatctacttgcagacctgggcattgatgaaaatagtcgtctcaagaaactatcaaaagaaaacaaagaaaaggttcaactgattttggttatgagccgtgatgctcgtctctatgttttggacgaacccattggtggggtggatccagcagcccgtgcttatatcctcaataccattatcaacaactactcaccaacttctaccgttttgatttctacccacttgatttctgatatcgagccaatcttggatgaaattgtcttcctaaaagacggaaaagtcgtccgtcaaggaaatgtagatgatattcgctacgagtcaggtgaatccattgaccaactcttccgtcagaatttaaggcctaagcaaaggagattatttatgttttggaatttagttcgctacgaatttaaaaatgttaacaagtggtatttagccctctacgcagccgtgctagtcctttctgccctcatcggaatacagacacaaggctttaaaaatctaccttaccaagaaagtcaggctactatgctactttttctagctacagtctttggtggcttgatgcttacacttgggatttcaaccattttcttgattattaaacgcttcaaaggtagtgtctacgaccgacaaggctatctgactttgaccttgccagtttctgaacaccatatcatcacagccaaactaatcggtgcctttatctggtcattgattagcaccgctgtattggctctaagtgctgttattattctggctttaacagctccagaatggattcctctttcttatgtgattacatttgtagaaacacatctccctcagatctttcttacaggtatatccttcctactaaatactatttcaggaatcctctgcatctacctggctatttccattggacagcttttcaatgaataccgtacagcactcgctgttgcagtctacattggtatccaaatcgtcattggatttattgaacttttcttcaatcttagttctaatttctatgtcaattcactggtaggactcaatgaccatttctatatgggagcaggtatagccattgttgaagaactcatattcatagctatcttttatctcggaacctactacatcttgagaaataaggttaatttgctttaa

SEQ ID NO: 152 - DNA, 1185 bp, Streptococcus pneumoniae
aaaagctgtccgcaagttgttccagatgtcattgacctcttggtaacaccattcgtgacacttttggtcatgtctatccttggactctttgtcattggaccagttttccacgttgttgaaaactacatccttattgctacaaaagcgattcttagcatgccatttggtcttggtggtttcttgattggtggggttcaccaattgatcgtcgtgtcaggtgtgcaccacatcttcaacttgcttgaagtgcaattacttgctgctgaccatgctaacccattcaacgctatcatcacagctgctatgacagctcaaggtgctgctactgttgcggttggtgttaaaacaaaaaatccaaaactgaaaacacttgctttcccggctgctctttctgccttcctaggtattacagagcctgctatcttcggggtgaacttgcgcttccgtaaaccattcttcctttcattgattgctggtgcaatcggtggtggattggcttctatccttggacttgctggtactggtaatggtatcaccatcatccctggtacaatgctttatgttggtaacggacaacttccacaataccttcttatggtagctgtatcatttgcccttggttttgctcttacttacatgtttggttacgaagatgaagtagacgcaactgcagctgcaaaacgagctgaagtggctgaagaaaaagaagaagttgcgccagcagctcttcaaaatgaaacacttgtaactcctatcgtcggtgatgttgtcgctcttgctgatgtcaatgacccagtcttctcaagtggagctatgggacaaggtatcgttgtgaaaccaagccaaggcgtggtctatgcaccagctgatgctgaagtttcaattgcctttccaacagggcacgcttttggtttgaaaacaagaaatggtgctgaagttttgattcatgttggtattgatactgtatctatgaacggtgacggttttgaaacaaaagttgctcaaggtaataaggtgaaagctggcgatgttcttggaacatttgactcaaacaaaatcgctgcagctggacttgatgatacaacaatggttatcgttacaaatacaggtgactacgcttcagtagctccagtcgcaacaggttcagttgctaagggggatgctgtgatcgaagtgaaaatctaa

SEQ ID NO: 153 - DNA, 792 bp, Streptococcus pneumoniae
aatcgctttcaaacaagaacaaaatgttatataaggagatttttgcaaatgaacaatcaggaaattgcaaaaaaagtcatcgatgccttgggcggacgtgaaaatgtcaatagtgttgcccactgtgcgactcgtctacgtgtcatggtcaaagatgaagagaaaatcaataaagaagtgattgagaacttggaaaaagttcaaggtgctttctttaactcagggcaataccaaattatctttggtacaggtacagttaacaaaatgtacgatgaagttgttgtacttggattaccaacatcatctaaggatgacatgaaagcagaagttgctaaacaagggaactggttccaacgtgctatccgtacttttggtgatgttttcgttccaatcatcccagttatcgtagcgacaggtctcttcatgggtgtgcgtggtcttttcaacgctcttgaaatgccacttccaggtgactttgcaacttacacacaaatcttgacagatacagccttcatcatcttgccaggtttggttgtgtggtcaaccttccgtgtatttggtggaaatcctgccgttggtatcgttcttggtatgatgcttgtctctggctcacttccaaacgcttgggcagttgctcaaggtggtgaagtaacagcgatgaacttctttggtttcatccctgttgttggtttgcaaggttccgttcttccagccttcatcatcggggttgtcggagctaaatttgaaaaagctgtccgcaagttgttccagatgtcattgacctcttggtaa

SEQ ID NO: 154 - DNA, 651 bp, Streptococcus pneumoniae
acaaaatcaagaattttctgtctattttttgaatatttatggagaatgagactgatgaaaatatggtataatgaaataaaggagttttatatgcaaaaatttattcaggcttatattgaaaagctagatgtgacaaccattatcgagaatattctaaccaaggtcatttctcttttactgcttttaattgtattttatattgctaaaaaaatgcttcataccatggtgcagagaattgtcaaaccttctctaaaaatgtctcgtcatgatgttggacgccaaaaaaccatctcacgtttactagaaaatgtgtttaattatacgctatatttctttttactctactgcattttgtcgattttaggtttgccagtttctagtttgctggctggagctggtattgctggggtagcgattggtatgggagcccaaggctttctgtctgatgtcatcaatggctttttcatcctctttgaacgtcaactggatgtgggagatgaggtcgttctgacaaatggaccgattactgtatcgggtaaggttgtcagtgtgggaattcgtacgacacagcttcgtagcgaggagcaagcccttcactttgtccctaaccgaaatatcacagttgttagcaatttctcacgcacagactag

SEQ ID NO: 155 - DNA, 1815 bp, Streptococcus pneumoniae
agaaataagaggaagaaaatggaacaaaaacaccgttcagaatttccagagaaggaactctgggacttaacagccctataccaagaccgtgaggatttcttgcgtgcaatcgagaaagctcgcgaagacatcaaccagtttagccgtgattacaagggcaatcttcacacttttgaggatttcgagaaggcctttgcggaattggaacagatctacattcagatgagccatattggcaactatggttttatgcctcagacgacggactatagcaatgacgaatttgccaatattgcccaagctgggatggaatttgaaacagatgccagcgtagccttgaccttctttgacgatgccttggtggcagcagatgaggaagtcttggaccgtttgggtaaattgccacatttaacagctgccattcgtcaggctaaaatcaaaaaagcccactacttaggggcagatgtggagaaggccttgacaaatctcggtgaagttttctacagtccgcaggacatttatactaagatgcgagctggggattttgaaatggctgactttgaagcccatggcaagacctacaaaaacagctttgtgacctatgagaatttctaccaaaaccatgaggatgctgaggttcgtgagaaatccttccgttccttctcagagggacttcgtaagcaccaaaatacggctgcagcagcctatctggctcaggtcaagtctgaaaaactcttggctgatatgaagggatacgactctgtctttgactatcttctagctgaacaagaagtggaccgtgtcatgtttgaccgccagattgacctcatcatgaaggactttgcaccagtcgctcagagatacctcaagcatgttgccaaggtaaatggtcttgaaaagatgacctttgcagactggaaattggacttggacagcgccctgaatcctgaagtgactattgacgatgcctatgatttggtcatgaagtcggtagaacctttggggcaagaatattgtcaggaagttgctcgttaccaagaagagcgctgggtggactttgctgctaacagtggcaaggattccggtggttatgcggcggacccatatcgcgtacacccttatgtactcatgagctggacaggccgtttgagcgatgtctataccttgattcatgaaatcgggcattctggtcaattcatcttttcagacaatcatcaaagttacttcaatgcccatatgtcgacctactatgttgaagcaccgtcaaccttcaatgaattgctactcagtgattacttggagaaccagtctaatgacccacgtcaaaaacgcttcgctctggctcatcgcttgacagacacctacttccataactttatcacccacctcttggaagccgccttccagcgtaaggtgtatacattgattgaagaaggggagacctttggagcaagcaagctcaacagcattatgaaggaagttttgacggatttctggggagatgctattgaaattgacgatgatgcaactctgacttggatgcgccaagctcactactatatgggcttgtatagttacacttactcagcaggactagttatctcgactgctggttaccttcatctaaaacattctgaaactggagctgaagactggctcaatctcctcaaatcaggtggtagcaagacaccacttgagtcagccatgattatcggtgctgatatttcaacagacaaaccactccgtgataccatccaattcttgtctgacacagttgaccagattatctcctatagtgctgagttgggagagtag

SEQ ID NO: 156 - DNA, 615 bp, Streptococcus pneumoniae
atcaatgacgggaaaaatagtttaaatgttaaatcgaaaggattgtatatgtcaaaagcaaagaaaatatgtttcattattttctgtattttaatcttgacaattttccttcctgttttgatagattatcatcaagttagtgatctaggtattcatctacttagctggagacagaactccgtagttgaattctatcttgctagatatgtcttttgggggacagtggttctatcaactttagttttattatccattttagttgtgatgttttatcctaaacgttacttggaaatccaacttgaaactaaaaacgatacattaaaattaaagaattcggcaatcgaaggttttgttagaagtttggtgagtgatcatagattgatcaagaacccaactgttcatgtaaatttacgaaaaaataaatgtttcgttcatgtagaaggtaaaattcttccttcagacaacatcgctgacagatgccaaataattcaaaatgaaataactaatggattgaagcagttttttggtattgagcgtcaagtaaaacttgaagttgcagtaaaaaattaccaaccaaaacctcaaaacaaaaagactgttagtcgtgtgaagtaa

SEQ ID NO: 157 - DNA, 666 bp, Streptococcus pneumoniae
ataagtatgattgatttttatttttttctcgtcgggagcattctagcttcctttcttggtttggtcattgaccgttttccagagcaatccattatcagttcagccagtcactgcgattcctgtcagactcccttgcgtcccttagatttgattccgattctctcacaggtcttcaatcgctttcgctgtcgctactgcaaagttcgctatcctgtctggtatgccctctttgaattaagcttaggactcctctttctgctttactcttggggatggctctccttggggcaagtcgtcctaatcaccgctggtttgaccttgggtatctacgactttcaccatcaggaatatcccttactggtctggatgactttccagctaatcctaatagcttcctctggctggaatctggtcatggtctccttcctcatacttggaattttggctcattttatcgatatccgcatgggtgcaggggatttcctctttttagcttcttgtgctctcgtctttagcgtaacggagttactgatcttgattcagttcgcttctgcgacgggtatcctggcctttctcctgcaaaagaaaaaggaaagacttcctttcgtgcctttcctcttacttgctacttgtttgattatttttggtaagctactgcttgtctga

SEQ ID NO: 158 - DNA, 1152 bp, Streptococcus pneumoniae
atgtttaatggtcgggtattgaaagaattacggctgttaaatggtttaagtagagcagaattagctcagagaattaatttaacggaacaagccatttggcagtttgagtccaacgaaacgaaacctaaattatcaaccaaaatgcatttggccaaccaatttcatgttgatttaacttattttgaacaggaagaagagagcattcgatttgattcttctgtaattgcctttagaaatgcagacctagcaacacggaaaacaatagatattcaaactatgtatttacataaggtagatagtttgattgattattttgaaagttttgtaattatacctaatattataattcatgacctaagtaatgtagtgagtgaatcttatcataagggagaatccattgaggaattggctctttatgccagggaaaaattaggtatttcaaaagataatcatgatttgctttataaattagaacgttcaggcatctatatcgtggaacgattaattaatggccaagctgatgcttatagcgcatggtcaaaattgggaagaccttatattgtgttaggaacgaataaatcatctgtacgtcgaaattttgacttagctcatgagctaggacatattcttttacataaatataaagatatgaatgaagatggcgatcgtttggagcaagaagcaaattattttgcatcatgttttttattgccaaaagaagagtttttagtcaaatttgaagagagggttggcaagcgtgtcagcaatcctgatagttatattttattgaagtcggatttgaatgtttcgatacaggctttagagtatcgagcttttaagttaggattattgactccaaagcaacattcttacttttatcgtcaaattgcgcaaaaaggttacaaaatgattgaacccttggatgatcaaatttttgttaaaaaaccaagcaaagtaaagagtattctggacgtcgttttgagtaatcatctagtcagtctagcgactataatgtctaaacaaagtattcgtttacagtttataagcgaaatattttcagtcgaaatgaaattttttgatcagtatcaagaagatagaagaacagatcgatttgataacatcatccctttgtacaaaagaaataatttataa

SEQ ID NO: 159 - DNA, 1788 bp, Streptococcus pneumoniae
gtattggcctcaggtttccatttgcaatcagaaagggattttatgtccattattcaaaaactttggtggtttttcaagttagaaaaacgccgttatctagtcggaattgtggccctgatcttggtttccgtcctcaatctcattcctcctatggttatggggcgggtcattgatgccatcacatcggggcaattaacccagcaggacctccttcttagcctattttacttgctacttgcagcctttggtatgtactatttgcgctatgtgtggcgtatgtatatccttgggacctcttattgcttgggacagatcatgcggtctcgcttgtttaagcatttcacaaaaatgtcgtcagccttttatcaaacctatcggacgggtgatctgatggcacacgcaaccaatgatatcaatgccttgactcgtttagcaggtggcggtgtcatgtctgcggtggatgcctctatcacggctctggtgactttgttgaccatgctctttagcatctcatggcagatgactcttgttgccattctccccctacctttcatggcctatacgactagtcgcctagggagaaagactcataaggcctttggcgaatcccaagctgctttttctgaactcaataacaaggtacaggagtccgtatcaggtatcaaagtgaccaagtctttcggttatcaggcagacgagttgaagtcttttcaggcagtcaatgaattaaccttccaaaagaacctgcaaaccatgaaatatgatagtctctttgaccctatggttctcttgtttgttggttcgtcctatgttttaacgcttttggttggctccttgatggttcaggaagggcagattacagttgggaatctagtcacctttatcagctatttggatatgctggtctggcctcttctggccatcggtttcctctttaatactactcagcgagggaaggtttcttaccagcggattgaaaatcttttgtctcaggaatctcctgtacaagaccctgagtttcctctggatggtattgaaaatgggcgtttggagtatgccattgacagctttgcttttgaaaatgaggaaacactgacggatattcactttagtttggcaaaagggcaaacactgggcttggttgggcagacaggctctgggaaaacgtccttaatcaagctcctcttgcgtgaatacgatgtggataagggtgccatttatctaaacggtcacgatattcgggactatcgtctgacagaccttcgcagtctcatgggctatgttcctcaggaccagtttctttttgcgacttcaatcctagacaatatccgctttggcaatcctaacttgcccctttcagcggtcgaggaagctactaagctagcccgggtttaccaagatattgtagacatgcctcaaggatttgatacgctgattggtgaaaaaggagtcagtctttctggtggtcaaaagcaacggttggctatgagtcgggctatgattttagaccctgatatcttgattttggatgattccttatccgccgtagatgccaagacagagtatgcgattatcgacaacctcaaggagatgcgaaaggacaagacaaccattatcactgcccatcgcctcagtgctgttgtccatgcagattttattttagttctacaaaatggtcaaattatcgaacgaggcacgcacgaagacttgctagctttggatggctggtatgcccaaacctaccagtctcagcagttggaaatgaaaggagaagaagatgcagaataa

SEQ ID NO: 160 - DNA, 2127 bp, Streptococcus pneumoniae
tctagtttaatgaacacctgtatctattttaccatacaagtgctagaaaatttacaaaaaaacaccctttttataccaaacaagttgcagacaagtttggtatcgtttacaatatacttatcaaatcaaacttgctttgacaagtataaggagaatcaaatgggaaaatttgaacaagaagccaaagatctgcttcaggcaatcggaggcaaagaaaatgtgactgccgtaactcactgtgcgacacggatgcggtttgttttaggagatgataagaaggctaatgttaaagctatcgagtcaattccagctgttaaaggaacctttacaaatgcaggtcaatttcaggtaatcattggaaatgacgtgcccatcttttataatgattttacagccgtttcaggtattgagggtgtttccaaagaagcagccaagtctgcagctaagagtaatcaaaacgtggtccaaggtgttatgaccactctggcggagatttttactccgattattccagccttgatagtcggaggattgatcctcggtttccgtaatgtcttggaaggtgtccattggtcgatgttggatggcaagaccatcacagaatcctctcagttttgggcaggtgtcaatcacttcctctggttgcctggtgaagctatcttccagttcttaccagtagggattacttggtctgtttctcgtaagatgggaaccagccaaattttgggaattgttctcggaatctgtttggtatcgcctcagttgctcaatgcctatgcggttgcttcaacgccagcagctgatatcgcggcaaactgggtttggaattttggctattttactgttaatcgtatcggttaccaagcccaagttatcccagccttgcttgcaggtttgagtctgtcttatcttgaaatcttctggcacaagcatatcccagaagtcatttctatgatttttgtacctttcttgtcattgattccagccttgattttggctcatactgttttgggaccaatcggttggacaattggacaaggactttcatcagttgtcttggcaggtttaactggtccagttaaatggctcttcggtgcaatttttggcgccctctacgctccatttgtcatcacaggtctgcaccatatgaccaatgccattgatacacaattgattgcggatgctggtggcactgccctatggccaatgattgctctttctaatattgctcaaggctcagccgtgtttgcctattatttcatgcatcgccatgatgagcgtgaggctcaggtttcacttcctgcaaccatttcagcctatctcggtgttacagaaccagctctttttggggttaacgtaaaatatatttatccatttgttgctgggatgactggttcagcccttgcaggcatgttatccgttacttttaatgtaactgcggcttctattggtatcggtggtttgccaggtattctctctattcaacctcaatacatgctgccatttgcaggaactatgctagttgcgattgttgttccaatgctcttgactttcttcttccgcaaggctggtctctttacaaaaacagagggcgatacgaacttgcaggcagaattcgttgctcaagaagaagcagaatttgtgaaccatgaaccagtagaacttacttcggtagaaattatcagcccactaactggccaagtgaaagaattgagtcaagcgacggatcctatttttgcatcaggtgtcatggggcaaggtctagtcattgaaccaagccaaggtgagttgacctctccagttaatgggacagtgacggttcttttccctaccaagcatgccatcggcattgtctctgacgagggagttgaattgctcatccacatcggtatggatacagtaggtcttgatggcaaaggttttgaaagtcttgtagtccaaggagatcacgttacagttggtcagcaactgattcgttttgatatggatgtcattaaggctgcaggtctggtgacagaaactcctgttatcatcaccaaccaagatgcttatacagcgactattcccggaacttatccgacaacgatccaagctggagcatctctcatggtcgctacacgaatctaa

SEQ ID NO: 161 - DNA, 621 bp, Streptococcus pneumoniae
gctcaggctgaaacagtctcccaggctgtttcactcccgaatgctaaaatcgttcttgatcgctttcacattgtacaacatcttagccgtgctatgagtcgtgtgcatgtccaaatcatgaatcagtttcatcgaaaatcccatgaatacaaggctatcaagcgctactggaaactcattcaacaggatagccgtaaactgagtgataagcgattttatcgccctacttttcgcatgcacttaacaaataaagaaattcttgacaagattttaagctattcagaagacttgaaacaccactatcagatctatcaactcttactttttcactttcagaacaaagaccctgagaaatttttcggactcattgaggacaatctgaagcaggttcatcctctttttcagactgtctttaaaacctttctcaaagataaagaaaagattatcaacgcccttcaactacactattctaatgccaaactggaagcgaccaataatctcatcaaacttatcaagcgcaatgcctttggttttcgaaactttgaaaacttcaaaaaacggatttttatcgctttgaacatcaaaaaagaaaggacgaaatttgtcctttctcgagcttag

SEQ ID NO: 162 - DNA, 1080 bp, Streptococcus pneumoniae
ataggagtagaaatgacaaaagaaaaaaatgtaattttgactgctcgcgatattgtcgtggaatttgacgttcgtgacaaagtattgacagccattcgcggcgtttcccttgaactagtcgaaggagaagtattagccttggtaggtgagtcaggatcaggtaaatctgttttgacaaagaccttcacaggtatgctcgaagaaaatggtcgtattgcccaaggtagtattgactaccgtggtcaggacttgacagctttatcttctcacaaggattgggaacaaattcgtggtgctaagattgcgactatcttccaggacccaatgactagtttggaccccattaaaacaattggtagtcagattacagaagttattgtaaaacaccaaggaaaaacagctaaagaagcgaaagaattggccattgactacatgaataaggttggcattccagacgcagatagacgttttaatgaatacccattccaatattctggaggaatgcgtcaacgtatcgttattgctattgcccttgcctgccgacctgatgtcttgatctgtgatgagccaacaactgccttggatgtaactattcaagctcagattattgatttgctaaaatctttacaaaacgagtatcatttcacaacaatctttattacccacgaccttggtgtggtggcaagtattgcggataaggtagcggttatgtatgcaggagaaatcgttgagtatggaacggttgaggaagtcttctatgaccctcgccatccatatacatggagtctcttgtctagcttgcctcagcttgctgatgataaaggggatctttactcaatcccaggaacacctccgtcactttatactgacctgaaaggggatgcttttgccttgcgttctgactacgcaatgcagattgacttcgaacaaaaagctcctcaattctcagtatcagagacacattgggctaaaacttggcttcttcatgaggatgctccgaaagtagaaaaaccagctgtgattgcaaatctccatgataagatccgtgaaaaaatgggatttgcccatctggctgactag

SEQ ID NO: 163 - DNA, 942 bp, Streptococcus pneumoniae
gaaaggaggcaaataatgtctacaatcgataaagaaaaatttcagtttgtaaaacgtgacgattttgcctctgaaactattgatgcgccagcatattcttactggaaatcagtgtttaaacaatttatgaagaaaaaatcaactgtagtcatgttgggaatcttggtagccatcattttgataagtttcatctacccaatgttttctaagtttgatttcaatgatgtcagcaaggtaaacgactttagtgttcgttatatcaagccaaatgcggagcattggttcggtactgacagtaacggtaaatcgctctttgacggtgtctggttcggagctcgtaactccatcctcatttctgtgattgcgacagtgattaacttggttatcggtgtttttgtcggtggtatttggggtatttcaaaatcagttgaccgtgtcatgatggaagtttacaacgtcatctcaaacatcccacctcttttgattgttattgtcttgacttactcaatcggagctggattctggaatctgatttttgccatgagcgtaacaacatggattggtattgccttcatgatccgtgtgcaaatcttgcgctatcgtgacttggaatacaacttggcgtcacgtactttgggaacaccaaccttgaagattgttgccaaaaatatcatgcctcaattggtatctgttattgtgacaaccatgactcaaatgcttccaagctttatctcatacgaagccttcttgtctttcttcggtcttggattaccgattacagtgccaagtttgggtcgtttgatttcggattattcacaaaacgtaacaaccaatgcttacttgttctggattccattgacaacccttgtcttggtatccttgtcccttttcgtagttggtcaaaacttagcggatgctagtgatccacgtacacatagatag

SEQ ID NO: 164 - DNA, 1533 bp, Streptococcus pneumoniae
ggagaaggttcttttgggatttttaaaggaaataatatgaaaaaatatatttttatgcgtgttttgcggtcattggtttcgattttcttagtaacgactttgacctacacgattatctataccttggttcctcgaaaattgattttcaagcaggatcctaactataataaaattgcgacaacggctgataaacgtgataactatgaaaatactgtgtttgagcgtatgggctacattgagtattacgatactaaagagttgcaagaaaaggcaagtagcatggattcttctgtaacagtagaagcaaatgcgaccaataaagctatttatgaaaagtacatcaatcaattaggtcatggttggactttgggagaatttactgaaagtggtcaattctatgctactcgtgaaattccaatttttgaacgtgtttttcacttctatgctaacttgattgacattgaccatacaaataaaatccaagaccctgaaaatccagacttgaaacgctaccttcgttttgaaaatgatccagctatcggatggtcattggtcggttcaggaactaaacataaatatctcttgtactttaacagtcagttcccatttgttcatcaaaactttgtgaacttgaatttaggtgactcttacccaacctatgctaatacaccagttcttcaggttattactcaaggtcaaggacaaaccaaaactgcccaagttcagttcccaacaggtaagaaaacgtcttctgtaaatatttactcaagaacctacaagtcacctagtcaggctgactctcgtgaagtagctagctatgggaaagatgatccttatacagcgactgaaagtaattaccaatatccatctatgattgtcagctctgctattactggtttgattggtttggttcttgcctatgctcttgccgtgccacttggttcagccatggctcgtttcaagaacacttggattgatagcctctcaacaggggctttgaccttcttgcttgctcttccaacgattgccttggtttacatcgttcgattgattggatcatctattgcccttccagattcattccctatcttgggagctggagattggcgttcttacgttttaccagcagtcatccttggtttgttgggtgctcctggtacagccatttggattcgtcgttacatgattgacttgcaatctcaagactttgttcgtttcgctcgtgcaaaaggtttgtctgaaaaagaaatttcaaacaaacacatctttaaaaatgccatggttccgctggtttcaggaattcctgctgccattattggggttatcggtggtgcaacccttactgaaacagtcttcgccttcccaggtatgggtaaaatgttgattgactctgtaaaagcatctaataactctatggtcgttggtcttgtcttcatctttacatgtatttctatcttctcacgtcttttgggagatatttggatgactattattgacccacgtattaaattgactgagaaaggaggcaaataa

SEQ ID NO: 165 - DNA, 1038 bp, Streptococcus pneumoniae
gttgtcatgggcttccttctcatgggagcactcttcatcgttcttccccgaactatggtctctgctaagcggattaatcaagttttagatttgcattcttctatccaaaaccctgttcaagtgcagctgactgatgaaaacttcaaaggtcaggtcgagtttaaggatgtgaccttccgctatgcggcaaattcggaggcagttattgaacatgttagctttaaagcagaaactggtcaaacagtggcctttattgggtcaacaggttctggtaaatcaactctggtcaatctgattccacgtttctacgacgtgtcagcaggagaaattctggtggacggtgtcaatgttcaagactatgacttctctgcgacagctcatgctggtcaaaaggttgccattgttgggccgactggggctggtaagacaaccattgtcaatcttttgatgaaattctatgagattgataagggaagtattcgcattgatggtgtggataccaaggctatgacgcgttcagaagtgcatgatgccttttcaatggtcttgcaggatacctggctctttgaaggaactattcgagacaatctcatctataatcaaatagggattagtgatgaacgaatgatggaagctagtaaggctgtgggaattcaccactttattatgaccttgccagatggctatgataccatcttggatgacaccgtgaccttgtctgtaagacaaaaacaactattgactattgctcgtgcccttcttaaggatgcaccgcttttgattttggatgaggcgacttcttctgttgacacacggacagaggaattgatccaaaaagccatggaccgtttgatggaaggacgcacatcctttgtcattgcccaccgcttgtcaaccatccgaaatgcagacttgatcttggtcatgaaagatggaaatatcatcgagcaaggcaactatgaggaactgatggcgcaaggtggcttctacgctgacttgtacaatagtcaatttacagaagatgaagcagaagaataa

SEQ ID NO: 166 - DNA, 873 bp, Streptococcus pneumoniae
gaggagagaataaagaaattagccaaaagaattagtagaaaagaatgggggatgattttactagccattctctttacttgcttttcggtctatctagagttggaagtgccgacctatatctcgaaaattacggatttgctaggtagtcaagaaactaatttagatgagttgtggcagtcggcaagcatgatgatgggaatgtcctttcttgccttcttgtccgtagttgcagttggattttttgcatcccgagtggcggcttcttatactagtaggctgagaagtgatatttttaaccgagttttggattactcgcagacagagattaagaaattttcaattcctagcctcttgacgcgtactaccaatgacattactcaagttcaaatgttgattactatgggcttgcaagtggtaacgcgtggttcaattatggctatctgggctattgggaagattttaggtcattcagaatactggctctgggccgtacttgtggcagtgattatcaacgtcctgatgacgaccgttttgatgacgctagcctttccaaaacagtccttgattcaggggctgacagataaactgaacagtatcactcgtgagagtttaacaggtattcgtgtcgttcgtgcctacaatgcagaggattatcaaaatgaaaaatttgcagcagtaaatgatgaattgacccgtttgaatttgtttgtcaaccgtcttatggctattttgaatcctatcatgatggggatttcaagtggtttgagtgtggcgatttactggattggggcctatgtgattaacgacgctgctccgatagcgcgtctgcctctctttagtgacatgattgttttcatgtcttatgccatgtag

SEQ ID NO: 167 - DNA, 1383 bp, Streptococcus pneumoniae
tataatagctttatgaataaaaaacgaacagtggacctgatacatggtccgattcttccctcgctcttaagcttcacctttccaattttgctatcaaatatttttcaacagctctataacactgctgatgtcttgattgttggacgatttcttggtcaagaatccttggctgcagtaggagcgacgacagcgatttttgacctgattgtaggttttacacttggtgttggcaatggcatggggattgtcattgctcgttattatggggctcggaatttcactaaaatcaaggaagcagtagcagccacctggattttaggtgctcttttgagcattctagttatgttgctgggctttcttggcttgtatcctctcttgcaatacttagatactcctgcagaaattcttcctcaatcttatcaatatatttctatgattgtgacctgtgtaggtgtcagctttgcttataatctttttgcaggcttgttgcggtctattggtgacagtctagcagccctgggatttctgattttctctgccttggttaatgtggttctggatctctattttattacgcaattgcatctgggagttcaatccgcaggacttgctaccattatttcgcaaggtttatcagcggttctctgcttttattatattcgtaaaagtgtgccagaactcttgccacagtttaaacatttcaaatgggacaaaagcttgtacgcggatctcttggagcaaggtttggctatgggcttgatgagttcaattgtatctatcggcagtgtgattttacagttttctgttaatacatttggtgcagtgattattagtgcccagacggcagctcgacgcattatgacctttgcccttcttcctatgaccgctatttctgcatcaatgacgacctttgcttctcagaatctaggagctaagcgacctgaccgtattgttcaaggtcttcgaatcggcagtcgtttaagtatatcctgggcagtttttgtttgtattttcctcttttttgccagtccagctttggtttccttcttggctagttcgacagatggttacttgatagaaaatggaagtctctatctgcaaatcagttcaaccttttatcccattttgagcctcttgttgatttatcgcaattgcttgcagggcttggggcaaaagatccttcctctagtttctagctttattgaactaatcggaaaaatcgtttttgtggttttgattattccttgggcaggatataagggtgttatcctttgtgaacctcttatctgggttgccatgacagttcaactgtacttctcattattccgtcatcccttgataaaagaaggcaaggcaatcttggcaaccaaagtgcaatcctag

SEQ ID NO: 168 - DNA, 636 bp, Streptococcus pneumoniae
gaagggagagagaagatgaaatcaatgagaatcttatttttgttagctttaattcaaatcagtttgagtagctgtttcctatggaaggaatgcatcttgtcctttaaacaaagtacagcttttttcatcggaagcatggttttcgtttcaggaatctgtgctggagtaaattatctttatacccgtaagcaagaagtccatagtgtcctagccagtaagaagtcggtgaagcttttttacagtatgttactcttaattaatttgttaggagctgttcttgttttgtcagataacttgttcatcaaaaatacgctgcagcaagaattagttgactttttattgccatccttctttttcctatttgggctagatttgctgatttttttacccttgaaaaaatacgtgcgcgattttcttgctatgctggacagaaaaaagacagtgttggtgactattttagcaacacttcttttcttaagaaatccaatgaccattgtctcacttctgatttatattggactgggcttgttttttgcagcctatcttgtcccaaattcggttaagaaggaagtttccttttatggtcatattttccgagatcttgtattggtcattgttacgctcattttcttttag

SEQ ID NO: 169 - DNA, 2154 bp, Streptococcus pneumoniae
acaagaagaaattatcgactttattttgaacaaggaggaagtattgtgaaaattccaatgatatatcaaatggaaaattcagaatgtggattagcatgctgtgccatgatattgaactattttaaatatgagatttctttaaatgaactacgtgaaatctacccatcatccagatctggatattctctcctatctataagtaaagttttaggagattttaatataagttctcatgcttttaaagcttcggtaagagatttaaaaccgctcagtttcccactcatttgcttctgggagagttctcattttattattcttgaaaaaattagtaaaaacaagttttatattttagatcctgcaaaaggcaggcagagaatgtcaataagtgaatttgaaaggcattattcaaatatcattttaacatttaaaaagttagatagctttatgtctcgtaaagataataagaagtcgcctgttttaaagtatttttttaagtataggaataagctagggattttattttttgtaacagcattattgtatgtaatacaatcattagtacctatagctaatagatacataattgacacgaatttcaaggacgattcgtattcgtctagaatgttatttactatattatttatatttactgtttcattctcactaatgtatttattaagacagatatatgttgcatccttaaaatatataatggataaagagattagctatgattttatgaaacatttgatatatttaccttacagtttttatgaaaaacgtactttaggggatatactttttagagctaactctattgtttatataagagaaatactatcaaataattttatagcagctatacttgatttgttaatgattgtggtttatgctgtggttttatttagcttttctaagtacatggtaatctttttaatatcactaagtctagctctatctattgtaatgtatccaatcataaaaatctcaaaaaatttaattgataaaaatataaaagaaaaggttaatgttcaaaatattacttccgaagtaatttctaaaaatagtgatattaagctaactggagaagaggaattttggattaacaaatgggataattttaatacaaaacagctcatcataggtcgaaaacttgatatacatttatcaattgttagtagtataacgaatgttttacaaattattctccctgttttgacccttattgtaggtgtaaatataaaaacattcgaacaattgacgttaggacaaattgtagcaataagtacagtctcaccatactttatttctcctataatttctttaagtgataactatatacaattaatgttattaaagggatattttttaagaatagaggatgtgtttaatactaaatccgaattaattccagaaagagtcagtcaagatataaaatttgataaaaaaatagaattaaaagatatttggtataaatatggattatttgatgattatgttttgaaaggaataaatgttactattaaaaaaggagaaactgttgctattgttggagaatcaggttcaggtaagagtacattagctaaaattttattaggtttattagaacctaatattggttcaatagaagttgatggagtagaaaaagaagaaattggtcaaacattgtatagaaagatttttggagcagtgttacaaaattcaaccctaagttatggtaccttaagagagaatttgacatttggacactttgtttcagatgaagaattaatgacaaatctaaattcaattggtcttagcaatgtagttaaatctttacctcttggattagagacaatcatcgctgaagaaggtaataacttttctggagggcagcagcaaatgatacttttagctcgttgtcttttgtcgaaaccttcggtagttgttttggacgaagcaacaagtagtttagataatttatctcaacaaattacaacttcttacttaagtgaaatcggtaccactaagattttaattgcccatcgactagatactatcaagtctgcagataagatcttagtaatgcataatggtgaaattgtagagattgggacccatagagaacttcttgaactaggaggcatttataagcaattgtattcaaataattag

SEQ ID NO: 170 - DNA, 369 bp, Streptococcus pneumoniae
ttatatgtttgtaaaaaaattctggaagaaacattaccagtaaaaaatggtataaaagtgttaaatataccaaacgtattgagatatgatttgaatatgttacaattagaatataaaaatgaacaaagttgggatagtttcatagataatgttaatttaattgagttggaagagagaattcaaactactattggaattaaacaaataaacacacacaatattattactattgcccgagaagggtactctcaaaattatttacctaacacttcagaaaatacatataattcattacaagtcagtttagttggagtattactactttttataagtatggtaaatattttatgggctaaaaaaagtaaatga

SEQ ID NO: 171 - DNA, 645 bp, Streptococcus pneumoniae
agggaggttaatatgattgaacttaaacaggtgagtaaatcttttggagaacgagagttattttcgaatctttcaatgacatttgaggctggaaaagtctatgccttaattggttcaagtggtagcggaaaaacaaccttgatgaacatgattgggaaattagaaccttatgatgggacgattttttaccgaggtaaagacttggccaattataaatcaagtgattttttccgtcacgaattgggctacctcttccagaactttggcttaattgaaaaccaaagtattgaagaaaaccttaagctaggtctcattggtcaaaagttgagtcggtcggaacagcggttgaggcagaagcaggctttagaacaggtcggcctggtttatcttgacctagataagcgcatctttgagttatcgggcggagaatcgcaacgggttgccttggcaaaaattatcttaaagaatccaccctttattctggcagatgagccaacagcttcaatagacccagcaacctctcagttgattatggagattttgctatctcttcgagatgataataggctaatcattatcgcaacacataatccggcaatttgggagatggctgatgaagtgttcacgatggatcatctgaaataa

SEQ ID NO: 172 - DNA, 1041 bp, Streptococcus pneumoniae
gaaatgaaaaaaaagattagatggcccttatacgtcattgcggccttgattgtgactttcttggcatttgtagtgcccttgccttattatatagaggttccaggtggttcggaagatattcgccaagtccttaaagtaaatgacacagaagataaggaagctggtgcctatcaattcgttacggttggtgttcaacatgccactttagctcatatgatttatgcttggttgacaccttttacagatattcgtagtgctcaggagactacaggtggttcttccgatgttgaatttatgcgaatcaatcaattctacatgcaaacatcgcaaaatatggccaagtatcaaggactaaaaacagctggtaaggatatcgaactcaagtactttggagtttatgttttgaatgtgacggataattcaacctttaaagggattctcaatatctctgatacagtcacagcagtcaatgatcagacctttgatagttccaaagacttgattgattacgtcagttctcaaaaattaggggattccgtcaaggtcacctatgaagaggatgggcaaaccaagtctgcagaaggaaaaatcatcaccttggaaaatggcaaaaatggaattggaatcggcttgattgaccgtacagaggtaatcagcaatgtcccaattagcttttcaacagctggtattggcggtccaagtgctggtctcatgtttagtctagctatctatactcaaatagctcacccagatcttcgtaatggtcgtattgttgccggtacaggtaccattgaccgcgatggtaatgtgggagacattggaggtattgataagaaggttgtagcttcggctagggcaggtgctgctattttctttgctcctgataaccctgttagcgaagaagaacaaaaggcgcatccggacgcgaaaaacaactaccaaacagccctagaagcggctaaaacaatcaagacggatatgaaaatcgtgcccgttaaaaccctacaagatgcgattgattacttgaaaaacaatccctaa

SEQ ID NO: 173 - DNA, 960 bp, Streptococcus pneumoniae
aaaggtataatttttaaagaaggaataaaaacagtgaaatctattaaacgttttgcactctcggctatgggagtggctatgttgcttgtcttgactggctgtgtcaatgtcgataaaaccacaggtcagccaacaggatttatttggaatacgatcggagcgcctatggctgaagccatcaagtacttcgctactgataaaggtctaggctttggtgtcgctatcattatcgtaaccattatcgtacgcttgattatcttaccacttggtatctaccaatcatggaaggcaacgcttcactctgaaaagatgaacgccctcaagcacgtccttgagccacaccaaacgcgtctcaaagaagcgactactcaagaagaaaaactcgaagcccaacaagctctctttgctgctcaaaaagagcacggtatcagcatgtttggcggtgtaggatgtttccctatcctccttcaaatgcctttcttctctgctatctactttgctgcccaacatactgaaggggttgctcaagcaagctacctaggcattcctctaggttctccaagtatgattttggttgcctgtgctggtgtcctttactatcttcaatcgctcctttcacttcacggagtagaagatgaaatgcaaagagaacaaatcaagaaaatgatttacatgagcccactcatgatcgtcgtcttctccctcttctcaccagctagtgtcacactttactgggttgtcggtggtttcatgatgattctccaacagtttatcgtcaactatatcgttcgtccaaaacttcgcaaaaaagtccgtgaagaactagccaagaacccaccaaaagcaagtgctttctctaaaccaagtggacgaaaagacgttacccctgaacaaccaactgctatcacaagcaagaaaaaacacaaaaatcgcaacgctggaaaacaacgttcgagataa

SEQ ID NO: 174 - DNA, 654 bp, Streptococcus pneumoniae
aaggaaaataagatgattgatattcaaggattggaaaagaaatttaatgaccgcgcgattttctctggtttgaatctcaagctggagaagggcaaggtttatgccttaatcggaaagagtggaagcggaaagacgacgctgctgaatatcttgggaaagctagaaaagatagatggtggaagggttctctatcaggggaaagatttaaaaaccattcccactcgtgagtattttcgagaccagatgggctatctctttcaaaatttcggcctcttagaaaaccaatcaatcaaagaaaatttggatttgggttttgttggtcagaaaatctcaaaagtagaacgtttggaaaggcaagtgggggctttagaaaaagttaatctagggtatttggatttagaacaaaaaatctatactttatctgggggagaggcccaacgagttgcccttgctaagactattttgaaaaatccacccttgattttggcagatgaaccaacagcagctcttgatcctgaaaattcagaggaggttatgaatctcttggtggatttgaaagatgaaaatcgaattatcatcattgcgacccataatcccctagtctggaataaggctgatgaaatcattgatatgaggaaacttgctcatgtgtga

SEQ ID NO: 175 - DNA, 2055 bp, Streptococcus pneumoniae
ccaagtaactttttggaggaaatgatgaaacgtttatttattttgatttcaatggtattagtatcgctttatatggtgataacttccgttgaccatcgagaagagattttatttggtaactatccttctgttgatgtgacaggaatgatgataaatcaaccagtagctagtcgcgaagaggtgacagaggctttgagtcacttggcggtagagcacaatagtctcattgctcgtcgaatcgttgagccaaatgaagctggagaaacacgctttacctatgccacttatggtgagggaaagcttccagaaggtctgaccatttcctccaaggagagtgcagaaacgagtgatttattagggtcttacttgattgtatcaggaagtttggatggagtgagcttacagaccaccttgaaagagcttggttatcaaggctttgtttcgaatggagaagatccattttcgatagtcttactattgacggccacccctatggtgctactgagtttagctatttttctgctgacctttatgagtctgaccctgatttatcggatcaaatcccttcgtcaggcagggattcgcttaatagctggtgagagcttgtttggagttgctctcagaccagtgttagaagatgtgagacagcttatctgctcagtgctggtatccagtcttttgggattggggattctctggtatcaaggtgccttgtttatggcaacggtgcaactggtcatcattgctcttctactttatggattgaccttggcagggatttctaccttactaagtgtcgtctatctacttggtttacaggaaaatagtctggtggatctattgaaagggaaactccctctcaaacgtatgatgacattgatgatggtggggcaactcttagctgtattggtggtcggatcgagtgcgacagctctcctaccccactaccgtgaaatgcaggaaatggagagagctagcaataaatggagccagtcctcagaccgttaccgtctatcctttggttggtctagtgcatttgccgatgaagaaggaacgcgtaaggataatcgtgagtggcagacatttactgaagaacggttagccaatacagactctttttatattatgagcaatgttgacaatttctcagatggagcagaagtggacctagatggcaatcgtctcagtgactacacaccgtcagggaatgttatctatgtctcaccgcgctatctgatagaagaaaagattaccgtttcttcagagtttatggacaagatgcaaaacttgtctgagggagagtttgggctgatcttgcctgagagcttgcgagagcagtctgtctactaccaaggattgtttacagattacctgcaaaacttttcatctgaaagtgtagaagtgacgagtcagaaacactacctcccacaggtaaggctagcttttacagaaacaggacaggaacgtttcctctataatgatgggtacaagacaacacgccagtacctaaaagatccgattattgtagttctaacgccgcaagcgactggaacaagacctgttgcagggatgttgtggggaactacggctaatagtgccttgaaactagatcgatatggagacagcatcacagctctaaaagagaaaggtctgtatcacaaggtttcttacttggtaaaaagccagctattttttgccaaggtactaaatgacaaacgggtggagttttactctctccttattgggacgattttgaccctgtctacggctatcttgttatttgattccatgaatcttctctattttgagcagttcagacgggaacttatgattaaacgtcttgctggtatgacaatctatgagcttcatggcaagtatttactggcgcaaggaggagttctcttgcttggcctagtcctatctagtattttgacaagagatggtttgattagcgctctagttgtagctttgtttacgcttaacgccctcttgattttagtaaggcaggacaaaaaagaagaagctggtagcatggcagtattgaaaggaaaataa

SEQ ID NO: 176 - DNA, 897 bp, Streptococcus pneumoniae
aaggagaatatcatgaatatgattaaggtagaaagcctaaataaaaacatcaagggcaaggctattttgaagggtatttcctttgaggtagctgaaggtgaatgcgtcgccttgattgggcccaatggtgctgggaagaccacactcttggactgtctgcttggagataaactggtcacaagcggtcaagtatccatccaaggcttgtcagtgacgagttctcagttagactatattagaggttatctgcctcaagaaaatgtcatcgttcagaaattaaaggtcaaagagttgattgctttctttcaacgtatctatccaaattccttgagcgatcaggaaatcgatcaactattgcagtttgaccagcaacaaaaagagcaattcgcagaaaaattgtcaggcgggcaaaagcgtctcttctcttttgtcttgaccttgattgggcgaccaaagcttgtctttttagatgaaccaactgctgccatggatacttcaactcgtcaacgcttttgggaaatcgttcgggacctaaaagcgcaaggagtcacgattctctattcgtctcattatattgaagaggtagagcatacggctgaccggattttggttttaaataagggagagttgattcgtgatacgacgcctctagctatgcgtagtgagggaattgaaaagcattttatccttcctctggcatacaaggaagtcattgagcagtctaacttggttgaaaactggtcacaaaaacaggatgctctacaagtagtcacacgcgaagcagatgctttttgggaactgttagttcaagcaggatgtggcatacaagaaattgaagttaataatcgtagtttgttggatacaatctttgaagaaacgcagaagggagataactaa

SEQ ID NO: 177 - DNA, 1320 bp, Streptococcus pneumoniae
ggagtaaagagaggagatattcatatgaaaaactcaaaatttatagaccaatttgccacctttgctggtaaactagggaaccaaattcatttaaaaaccctaagagatgcattcgtaacagtaatgccattatatattttggcaggtttaatcgttcttttgaacaacacggtatttaagtggattttccaaggggatacattaacaagattccaatattggggaataacaattgcaaacggtactttaagtatttcaggtatgattattgctgtaatggttggttatttcttagctaaaaacagagatttcgaaaacccgttagcagcatcaatgctatcattagtttctttaattgtgatgatgccaaatacagtttctgtagttcctgacggagcaaaagatgcggtaaacatttcaggtgttctttcattcaacaacacaggtacaggcgcaatgttcgccggggttatcgtagcgattattgcaacagaattattcattgaattatcaaacgttaaagctttacaaatgaaccttggtgaaaatattccaccagctgttagtagatcatttagcgtattacttccagtcatgaccgtcatctccttatttggggttgtttcagcattattattcaatataactggaatgaacttaatctcaatcattacaatctttattcaagaaccaattcgtcatattggtacaagcttaatcggggtcattattatttactctttaggaaatatgttatggctatttggtattcaccaagcagttatttacagtgccatcctagaaccattactattaattaacattactgaaaacatcactgcagcaaataatggacaagccattccacacatcatcaacctatcacaaatacaaacattcgctttaatgggtggtagtggatctacattatgtttattaatagcaacattcttagtgagtcgcaatgctgtctctaaaaacgtggctaaattatcttttggacctggtatcttcaatatcaatgaaccagtattattcggttacccaatcgtttataacatttcattagctattccatttatcacagttccagtccttggtattttaatcagctacttagcaacagttacagaattcatgagtcctgcatttatacaagttccttggactacaccagtattcttaaatgcatggttagcaacagcaggggacgtgagagcagttctagttcaattcatcatctttgcacttggagttcttctatacattccatttatcaaagttaatgacaaagttgttgaacaagaaatggaaggttaa

SEQ ID NO: 178 - DNA, 2706 bp, Streptococcus pneumoniae
acttgtgaaaaaattaacaaaggatatcgttccttgaaagctatggaggaaaatatggctgataaaaaaactgtgacaccagaggaaaagaaactcgttgctgaaaaacacgtagatgagttggttcaaaaagctctagttgcccttgaagaaatgcgtaaattggatcaagaacaagttgactacatcgttgccaaagcatcagtagcagctttggatgcccacggagaattggctttacatgcctttgaagaaacaggacgtggtgtatttgaagacaaagcaactaagaacttgtttgcctgtgaacacgtagtaaacaacatgcgccacactaagacagttggcgttatcgaagaagacgatgtaacaggattgactcttattgctgaaccagttggtgttgtttgtggtattactccaacaacaaacccaacatcaacagcaatcttcaaatcattgatttcattgaagacacgtaacccaatcgtctttgccttccatccatcagcacaagaatcatctgctcatgcagctcgtatcgtccgcgatgcagctatcgcagctggtgctcctgaaaactgtgtgcaatggattactcaaccatctatggaagcaacaagtgcccttatgaaccacgaaggtgttgcgacaatccttgcaacaggtggtaatgccatggttaaggcggcttattcatgtggtaaaccagctcttggggtaggtgccggaaacgttccagcttatgttgaaaaatcagcaaacattcgtcaagcagcacacgatatcgtcatgtctaaatcatttgataacggtatggtctgtgcatctgaacaagcagttatcattgataaagaaatttacgatgaatttgtagcagagttcaaatcttaccacacttactttgtaaacaaaaaagaaaaagctcttcttgaagagttctgcttcggcgtcaaagcaaacagcaaaaactgtgctggtgcaaaattgaacgctgacatcgttggtaaaccagcaacttggattgcagaacaagcaggatttacagttccagaaggaacaaacattcttgctgcagaatgtaaagaagttggcgaaaatgagccattgactcgtgaaaaattgtcaccagttattgcagttttgaaatctgaaagccgtgaagatggtattactaaggctcgtcaaatggttgaatttaacggtcttggacactcagcagctatccacacagctgacgaagaattgactaaagaatttggtaaagctgttaaagctattcgtgttatctgtaactcaccttctacttttggtggtatcggggacgtttacaatgccttcttgccatcattgacacttggatgtggttcttacggacgcaactcagttggggataacgttagtgccattaacctcttgaatatcaaaaaagtcggaagacggagaaataacatgcaatggatgaaacttccttcaaaaacatactttgaacgtgattcaattcaataccttcaaaaatgtcgtgacgttgaacgtgtcatgatcgttactgaccatgccatggtagagcttggtttccttgatcgtatcatcgaacaactggaccttcgtcgcaataaggttgtttaccaaatctttgcggatgtagaaccggatccagatatcacaactgtaaaccgtggtactgagattatgcgtgccttcaaaccagataccatcatcgcactcggtggtgggtctccaatggatgctgccaaagtaatgtggctcttctacgagcaaccagaagtggacttccgtgaccttgtccaaaaattcatggatatccgtaaacgtgccttcaagttcccattgcttggtaagaagactaaattcatcgcgattccaactacatctggtacaggatctgaagtaacaccatttgccgttatctctgataaagcaaacaaccgtaaatacccaatcgctgactactcattgacaccaactgtggcaatcgtagatcctgctttggtattgacagttccaggatttgttgctgctgatactggtatggacgtattgactcacgcgacagaagcatacgtatcacaaatggctagtgactacactgatggtttagcacttcaagccattaaattggtctttgaaaatctcgaaagctcagttaagaatgcagacttccactcacgtgagaaaatgcataacgcttcaacaatcgctggtatggcctttgccaatgccttcctaggtatttctcactcaatggcccataagattggtgcgcaattccacacaatccacggtcgtacaaatgctatcttgcttccatacgttatccgttacaacggtacacgtccagctaagacagcaacatggcctaagtacaactactaccgtgcagatgaaaaataccaagatatcgcacgcatgcttggacttccagcttctactccagaagaaggggttgaatcttacgcaaaagctgtctacgaactcggtgaacgtattgggatccaaatgaattttagagaccaaggaattgacgaaaaagaatggaaagaacattctcgtaaattagccttcctggcttatgaagaccaatgttcaccagctaacccacgtcttccaatggtagaccatatgcaagaaatcatcgaagatgcatactatggctacaaagaaagaccaggacgccgtaaataa

SEQ ID NO: 179 - DNA, 318 bp, Streptococcus pneumoniae
aagacaaaggagaaaacaatgaatccaaatattacttttttaatcatgcttgtaggtatgatggccttgatgttctttatgcaacgttctcaaaagaaacaagctcaaaagcgtatggaaagcttaaataaactacaaaaaggctatgaagtgattacaatcggtggactttatggaacagtcgatgaagtagatacggagaagggaacaatagttcttgacgtagatggagtttacttgacttttgaactagctgctatcaagacagtattaccgctgaaagaaacagcttcactagaaggcgcaattgaaaaataa

SEQ ID NO: 180 - DNA, 1824 bp, Streptococcus pneumoniae
actcgtatgcgcattaaatggttttccttgattaggattataggtttacttttggtactcttgtatcacttctttcagacgatctttcctggaggatttttcggggtagatgtctttttcacattttcaggtttcctgattacagctctactcattgaagaattttctaagaacaatgagattgatttgataggattttttagaagacgcttttatcggattgtgccacctgtggttttgatggtcttggtgaccatgccttttactttcttggttcgccaagactatgttgctggaattggtggccagattgcgggcgtcttaggctttatgaccaacttctatgaactcctaacaggtgggagttatgaatctcagttcattcctcatttgtttgttcataattggagtttggcagttgaggttcactactatattctttggggattggcagtttggttcttatccaaacaagctaaatcaaatggtcagttgaaggggatggtctttctcttatctgctgttgccttcttgatcagtttcttctccatgtttattggtagttttctagtgacctcttattcctctgtttatttctccagtttaactcatgtctatccattctttttaggaagtatgttagcaactattgtaggcgttcgtcagacgacttccctcgtcaagcagttggataaaatctgggatttacgaaagactttggtagtttttggaggaggctttggtttcctagttcttttgactttctttgtcaaattcacttatctttttgcctatcttatcggcttcttacttgccagtcttgcagctcttgccatgattctggcggcgcgtgtcttacatgaaaagacacatcatatacaggagtcgaagattatcagctttttagcggatactagctatgcggtttatcttttccattggcctttctatatcattttctcacagttgacatcaaatcttcttgctgtattactgactctgatttgttcttatggctttgccagtctgtcattttatgtattggaaccttggattgcaggcaagaacacacctattgtccaaacccttcgtcccctgccttatattcacgcaattcttgcagcaggtacaggaatcttgaccatcattgtctgcacggtgaccttgttggcaccacaagtgggagcgtttgagacagacttgactgtcaatggcttgaagcaagctgcaacaaatattggccagaccaaggtgatggcagaacgggcagatgcaaacagtttgggaattgctgatggcactatgttaattggtgactcagtggctttaagggcaaatacagcactacagacagctcttcctggagcacagattaacgcgcaggtcagcgtaacaaccaagaccgcaaatgaaatcatgctaaataatagccagaataaatttttacctaagacggtggtcattgcgactggggtaaataatcctgagaattacaaggatgactgggacagtatcgtgaaaaatcttcctaagggacaccatatgattttggtgactccttatgagggagataagacaaaagagacctatgccatcgttgagaaggctgctgcctatatgagagaattggcagagaagacaccttacattacgatagcagattggaatcaagttgcgaaagagcatccagaaatttgggctggaacagaccaggttcatttcgggagtgagagtagcactatcgaagcaggagcaaaattgtatgcagatacgattgccacagctttgcagacagctcaagacaagccggttaaatcaaaataa

SEQ ID NO: 181 - DNA, 360 bp, Streptococcus pneumoniae
atgtcaattattttaacaacgatcgttgctttggagcatttttacattttttatttggaaagtattgccacgcaatcagatgcgactagtcgtgtatttaatatggaaaaggaagaattggctcatccgtcagtaagttcattgttcaaaaatcaaggaatttataaggctctgctaggagtctttctcttgtatgtcatttatttctcacagaatttagaaattgtgactatttttgtcttatttgtgattggtgctgcgacttacggctctttaacagcggataaaaaaattattttgaaacaaggtggatcagctattttggccttgattagtattttactctttaaatacacttga

SEQ ID NO: 182 - DNA, 1848 bp, Streptococcus pneumoniae
tccacagcggcttattccaagtataccacttgggctttggcagtagctaactgcgctaaatataatataaggaggagtaaaatgaagacagttcaatttttttggcattattttaaggtctacaagttctcatttgtagttgtcatcctgatgattgttctggcgacttttgcccaagccctctttccagtcttttctggacaagcggtgacgcagctagccaatttagttcaagcttatcaaaatggcaatccagaacttgtatggcaaagcctatcaggaatcatggtcaatcttggcctgctggttttggttctatttatctctagtgtaatatacatgtgtctcatgacgcgcgtgattgcagaatcgaccaacgagatgcgcaaaggcctctttggtaagcttgctcagttgacggtttctttctttgaccgtcgacaagatggcgatatcctgtctcattttaccagtgatttggataatatcctccaagcctttaacgaaagcttgattcaggtcatgagcaatattgttttatacattggtctgattcttgtcatgttttcgagaaatgtgacgctggctctcatcaccattgccagcaccccattggctttccttatgctgattttcatcgtgaaaatggcacgcaaatacaccaacctccagcagaaagaggtagggaagctcaacgcctatatggatgagagcatctcaggccaaaaagccgtgattgtgcaaggaattcaagaggatatgatggcaggatttcttgaacaaaatgagcgcgtgcgcaaggcaacctttaaaggaagaatgttctcaggaattcttttccctgtcatgaatgggatgagcctgattaatacagccatcgtcatctttgctggttcggctgtacttttgaatgataagtctattgaaacaagtacagccctaggtttgattgttatgtttgcacaattttcacagcagtactaccagcctattatccaagttgcagcgagttggggaagccttcagttggcctttactggagctgaacgaattcaggaaatgtttgatgcagaggaggaaatccgacctgaaaaggctccaaccttcactaagttgcaagaaagtgttgaaatcagtcatatcgttttttcatacttgcctgataaacctattttgaaagatgtcagcatttctgcccctaaaggccagatgacagcagttgttgggccgacaggttcaggaaaaacgactattatgaacctcatcaatcgcttttatgatgttgatgctggtggtatttattttgatggtaaagacattcgtggctatgacttagatagtcttagaagcaaggtgggaattgtattgcaagattcggtcttgtttagcggaacgattagagacaatatccgatttggtgtgccagatgctagtcaggaaatggttgaggtagcagcaaaagcaacccacattcacgactatatcgaaagtttgcctgataagtacgatactcttattgatgatgaccagagcatcttttcaacagggcagaagcaattgatttcaatcgctcgaaccctgatgacagatccagaagttctcattctcgatgaagcaacttcaaacgtagatacggtgacagaaagcaagattcagcatgccatggaggtggttgtagcaggtagaactagtttcgtcattgcccaccgcttgaaaaccattctcaatgcagatcagattattgtccttaaagatggagaagtcattgaacgtggtaaccaccatgaacttttgaagctaggtggcttttattcagaactctatcacaatcaatttgttttcgaataa

SEQ ID NO: 183 - DNA, 768 bp, Streptococcus pneumoniae
aaggagcttcctagtatgggaacattttcagtcagacacctagacttattttacggggattttcaagccttaaaaaatatttcgattcaattaccagaaagacagattactgccttgataggcccatctggttgtggcaaatcaacttttctaaaaacccttaaccggatgaacgatttggttccttcttgccatattgaaggccaagtcctcttagatgagcaagatatttatagtagcaaattcaaccttaatcagctacgtaagcgtgtagggatggtttttcaacagcctaatccctttgccatgtctatctatgataacgtggcttatggcccaaggacacatggtattcgagacaaaaaacaattagatgccttagtggagaaatctttaaaaggggcagccatttgggaagaagtcaaagatgatcttaaaaagagtgccatgtccttatctggcggtcagcagcaacgcctttgcattgcgcgagctttagcagtagaacctgatattctgttaatggatgagccgacttcagccttagaccctatctccactttaaaaattgaagacctcattcagcaactaaaaaaggattatacgattatcattgttacccataacatgcaacaagcttcacgtatttcagataaaactgcttttttcttaacaggagaaatttgcgaatttggagataccgttgacgtgtttaccaatccaaaagatcagcgcacagaagactatatttcaggacggttcggataa

SEQ ID NO: 184 - DNA, 681 bp, Streptococcus pneumoniae
ttgatgaaggaaatctttgatagacgttaccctgtgacgagtttcttcctcttagtgacggccttggtatttttactaatgttggtcactgcaggcggaaactttgacagggcagatacattatttcgatttggagccatgtatgggccagctattcgcctctttcccgagcaggtttggcgtctcttgtctgccatttttgttcatattgggtgggaacatttcattgttaatatgctttcactttattatcttggaaggcaggtagaggagattttcggttctaagcagtttttctttctctatcttttatcaggaatgatgggcaatctctttgtttttgtatttagtcctaaatccttagcagcaggcgcctctacctctctttatgggctatttgccgcgattattgttcttcgctatgcaactcgcaatccttatatccaacagctagggcaatcctatctgacactttttgtggttaacattattggaagtgttctgattccaggaatcagcctagcaggccatatcggtggtgcagttggtggcgcatttctagcagttatctttccagttagaggagaaaaacggatgtataacaccagccagagattaggagcggtagtcttgttcgtaggactcgccattttgcttttctacaagggaatgggattgtga

SEQ ID NO: 185 - DNA, 789 bp, Streptococcus pneumoniae
aaaatcatacctaaaaacagacaaaaaggtttcaaatttgaggccttttttggtagaataggtatcattataacgaaccaggaggcacctatgactgctacaaaaatgaacgctcaagaaattatccaatttatcgccaatgctgaaaagaaaaccagtgtcaaagtaacctttgaggggcaactcgcaactgctgtgcctagctctgttgtcaaactaggaaatgtcctattcggagactggaaggatgtggctccgcttcttgaaggtttggtagaaaatcaagattatgttgtcgagcaagatgctcgtaattctgcagttcctttgctagataagcgtgctatcaacgctcgtatcgagccaggtgcgattatccgtgaccaggtggaaattggtgacaatgctgttatcatgatgggatctgttatcaatatcggtgctgaaatcggtgctggaaccatgattgacatgggtgccatccttggtggccgtgccatcgttggaaaaaatagccacgttggtgcaggtgcagttttggcaggtgtgattgagccagctagtgctgaaccagtccgtgtcggagacaatgttcttatcggtgctaatgcagtggttatcgaaggagtccaaatcggtagtggttcagttgtcgcagcaggagctattgttacccaagatgtcccagaaaacgtggtagtagcaggtgttccagctcgtattatcaaagaaattgatgcccaaactcaacaaaaaacagcgctagaggatgcgcttcgtaccttgtaa

SEQ ID NO: 186 - DNA, 1203 bp, Streptococcus pneumoniae
aggtcacaggttcgactgttaccagctattgggctaataagtcaggagcgccagcgacaagttatcgctttgctattggcggaagtgatgcggattatcagaatgcttggtctagtattgtggggagtctaccaactccatccagctccagcagttcaagtagtagttctagcgatagcagtaactcaagtactacacgaccttcttcttcaagggcgagacgataattctctaaatgaagtggccaatcaatggattgccacttttttcctttcgtgttacaataagggtatgaatcagtatcagaaaaagattgttaacggaaaaatttattcgctcctatccggcttaatatggggaatctgtggaattttaggagagtacttctttactcattatcaggtgtcttcgggctggattacctctatgcgtttgacactggcagggagtcttgtactcatttggtctgcaatacaattaaaatcgcaagtgctagatatttggcgagacaagaaaaattacctgccctttttagcctatgctattttggggattttttcagttcagtattttttctatctctgtgtagaatactcaaatgctacgacagcaactattttacagtttattagccctgtctttatcctcttttacaatcgcttggtttatcaaaaacgagcgtcaaaaagcgctgttttctatgttttggttgccatgctgggtgtttgcttgatggcgacaaagggagacctctctcagttatccatgacgccgctagctcttataacaggtttgctgagtgccatgggtgttatgtttaatgttatcttgccccaaccttttgctaagcgttatggttttgttcctacggttgggtgggggatgattttggcaggtttgtttagcaatgtcctctcgccggtttatcagctttcctttactcttgatatttggagtatcttgatttgcctcattatcgctttctttggaacggcttttgcttttttcatttccatgaaggctgtgtccttggtttctcctttggtggttgccgttatcagtgccagtgaacctctctcttctgctctcttgagtgttttgttcttaggattagtagtggattggtccctccttctagctatagccttgattattttacccatgatatttttgtctatagaagaagcgaaagaaagtagataa

SEQ ID NO: 187 - DNA, 588 bp, Streptococcus pneumoniae
aaaggagaaaagctcatgaacaaattaatgaaatttatttcggtttttttgacgtcaattgtgttaattgtatcagcgattccaagtgtttcagctgtatacgcttctgaacaagtatcacaaattgaaacaaatatggaacttcaacctgtcacttctctaacagaagaacaaatcaatacacttgcaaacgaaatccaatcttttcatccagacgtctcacaacaatggatcaaagaagtaattaaccgacaattacaaggcgattatacaatcccacctacatactctccatttagagcagtttggcaaggtattacagttaatcaaatgggtgctctattagatactgcaatagctttagcattaggaggaactactgcaggccttgcaaatctaattaaagtaaaaggaaaacatgcagcaaaaagtgctattcgttcagcaatttctagatatctaggtagttggtttgtaaatgatgttgctttagaattcgctatgaatttattatcaccggggacttatttagcacaattatgggataaaaatgatgccattcctaacaacggaaggattaacttttaa

SEQ ID NO: 188 - DNA, 1314 bp, Streptococcus pneumoniae
tatcctatgaaaggagttaatatggaaaagcaacaacctagtaaagcagccctgctgtctatcattcctgggttaggacagatttacaataaacaaaaagccaaaggttttatcttccttggtgtaaccatcgtatttgtcctttacttcctagcacttgcaacccctgaattgagcaacctcatcactcttggtgacaaaccaggtcgtgataattccctctttatgctgattcgtggtgccttccatctaatctttgtaatcgtttatgtactcttttatttctcaaatatcaaagatgcacatacgattgcaaaacgcattaacaatggaattccagttccacgcacactcaaagacatgatcaaagggatttatgaaaatggcttcccttacctcttgatcattccatcttatgttgccatgaccttcgcgattatcttcccagttatcgtaaccttgatgatcgcctttaccaactacgacttccaacacttgccaccaaacaagttgttggactgggttggtttgaccaactttacaaacatttggagcttgagtaccttccgttctgcctttggttctgttctttcttggactatcatttgggctttggcagcttctactttacaaatcgtaattggtatcttcacagctatcattgccaaccaaccatttatcaaaggaaaacgtatctttggtgttattttccttcttccttgggctgtcccagccttcatcactatcttgacattctcaaacatgtttaacgatagtgtcggtgctatcaacactcaagtattgccaatcttggctaaattccttcctttccttgatggagctcttattccttggaaaacagacccaacttggactaagattgccttgattatgatgcaaggttggctcggattcccatacatctacgttctgaccttgggtatcttgcaatctattcctaacgacctttacgaagcagcttatattgacggtgccaacgcttggcaaaaattccgcaacatcactttcccaatgattttggctgttgcggcacctactttgattagccaatacaccttcaactttaacaacttctctatcatgtacctcttcaatggtggaggacctggtagtgtcggaggtggagctggttcaaccgatatcttgatctcatggatctaccgtttgacaacaggtacatctcctcaatactcaatggcggcagctgttaccttgattatctctatcattgtcatctcaatctctatgatcgcattcaagaaactacacgcatttgatatggaggacgtctaa

SEQ ID NO: 189 - DNA, 888 bp, Streptococcus pneumoniae
tcgcattcaagaaactacacgcatttgatatggaggacgtctaagatgaataactcaattaaactcaaacgtagactgactcaaagccttacttacctttacctgattggtctatcaattgtaattatctatccactgttgattaccattatgtcagcctttaaagcaggtaacgtctcagcctttaaactagatactaatatcgacctcaattttgataactttaaaggcctcttcactgaaaccttgtacggtacttggtacctcaacactttgattatcgccttaattaccatggctgttcaaacaagtatcatcgtacttgctggttatgcttacagccgttacaacttcttggctcgtaaacaaagtttggtcttcttcttgatcatccaaatggtgccaactatggccgctttgacagccttcttcgttatggcgcttatgttgaacgcccttaaccacaactggttcctcatcttcctctacgttggtggtggtatcccgatgaatgcttggctcatgaaaggctacttcgatacagtgccaatgtctttagacgaatctgcaaaactagacggtgcaggacacttccgccgcttctggcaaattgttctaccacttgttcgcccaatggttgccgtacaagctctctgggccttcatgggacctttcggggactacatcctctctagtttcttgcttcgtgagaaagaatactttactgttgccgtaggtctccaaaccttcgttaacaatgcgaaaaacttgaagattgcctacttctcagcaggtgctatcctcatcgcccttccaatctgtattctcttcttcttcctacaaaagaactttgtttcaggacttacaagtggtggcgacaagggataa

SEQ ID NO: 190 - DNA, 825 bp, Streptococcus pneumoniae
aaaacaccttttagaaagatacctatgcttccatatccattttcctatttttcaagtatttggggggttcgtaagcccctgtccaaacgtttcgagctcaactggtttcaacttctctttaccagtatcttccttatcagcttgtctatggtacccattgctatccaaaacagctcccaggagacctatccgctagaaacttttatcgataatgtctatgaacctctgacagataaggttgtccaggatctctctgaacatgctacaattgtcgatggcacattaacttatactggaacagctagtcaagccccttctgttgtgattggtccaagtcaaatcaaggaattacctaaggacttgcaactgcatttcgatacaaatgagctagtcatcagcaaggaaagcaaggaactgacccgcatctcttaccgagccattcagactgagagtttcaaaagcaaagacagcttgacccaagcaatttctaaagactggtaccaacaaaatcgtgtctatatcagcctcttcctagttctcggtgcgagcttcctctttggtttgaatttctttatcgtctctcttggagctagctttctcctttatatcaccaaaagatcacgcctcttttcatttaatacctttaaagagtgctaccattttatcttgaactgtttaggattgccgactctgattacacttattttgggattatttggccaaaatatgacaaccctgattactgtacaaaatattctttttgttctgtatctggtcactatcttttataaaacacatttccgtgatccaaattaccataaatag

SEQ ID NO: 191 - DNA, 948 bp, Streptococcus pneumoniae
aagaagatgaaacaaacaaaacgaattaagcggtggcgctattatctgcgccgctttgcttatcagataaaaattttacgtgtcttacaaagtatctctcgagaaaagtatgatgagaagatttcggcctctctggtctatggttttttatcagcagtagcagttaatttctttttccaaccagggcatgtgtattcgagtggtgcaacaggtctggcacagattatctctgccttgagtaatcactggtttggttttcatattccgatttcgctaagcttctacgccattaacttccctttgatggtcttagcttggtatcagattggccataagttcaccgtctttacctttatcacggtatctatgagttccttctttatccagtttgtccctgtggcaaccttgacagaggatcccattatcaattccctttttgggggtgttgttatgggtttggggattggttttgctcttcgaaacaatatctccagtggtgggacggatatcgtcagcctgactattcgtaagaaaacgggtaagaatgtcggtagtatttctttcttggtaaatggaactatcatgctgatagcaggtttgacctttggttggaaatacgctctttattctatgattaccatctttgtctctagccgtgtgacagacgcagtctttactaagcaaaagcgtatgcaggccatgattgtgacaaatcatccagagaaggtaattgaaaaaatccataaaaaattgcaccgcggagcaaccatgatccacgatgcagaaggaacctataatcacgagagaaaggcagttttaatcactgtcattacacgtgcagagtttaatgaatttaaacagattatgacacaagtggatccaagctcctttgtctctgtctcggaaaatgttcatattctaggaagatttgttgagatagataattag

SEQ ID NO: 192 - DNA, 282 bp, Streptococcus pneumoniae
tttagtcggctttttgatgattctcatgctataatagagtcaggaggtcacatgaaacgagtaattttattagcagtgattcaggcagtcgttctatttttcatcattggagcgctagcttatgccttcaaaggcgatttcttctataactatctagcagttgtctttgctcctattgcaggtgtactgcgttttgggacggcttacataacggaaattgtcttgcctcgaaaggcagccgaaatcgctgaaaagcgtaaagcaggcaaaaattcaaaataa

SEQ ID NO: 193 - DNA, 840 bp, Streptococcus pneumoniae
tttggaacagagttttcgaattttattccaattacaccaatatgtcttaccagccttatatatttttcttattatcatttctttcttgacaggagagattcagttactagctttcttgcttgtaggagccatccatgtttatatcaatgtgatgcagttacctatggtaaaacgttatttcaaataaaggagttatctatgaaattacttaaaaaccttggctggattcttctagcccttctatcctttttatttatctatggctttattcaggggctcgcgactgcgtcgcttgctttaggcgcttcaccctatgctgttactctactctatgtggccttggctggagtatatgtgtacggcatttacaaatggtatcagaaggctcctgttcatattgagaagagcggctttaatcgatttatttggcttcctgtcttggtttggttcttatctctggtcgttcaattcttcttgccagatgatccttcagtaaatcagcaaatagcgacagacttgaccttgtctcaaccacttttctcattctttgctgtggttatttttgctcctttgacggaagagattgtttttagagggatgttagcacgctatctctttcctaagcaggacaatagtaaacgaaccctgatttttcttctggtatctagtcttctatttgccttgattcattttccaggtgatgtgcaacaattttttgtctattttagccttggttttagtttgggtttggcttacattagcagaaaaggtctggtctacagtatttctcttcacgctttgaataatttagtcggctttttgatgattctcatgctataa

SEQ ID NO: 194 - DNA, 717 bp, Streptococcus pneumoniae
attgttatttttgatgtctattgtcttggggggttcttgggcatgtttgtagggatgtttaaggcacgtgtcgaatcccacgaaattattttagatgtaaaagccttgatgccatggatatcagctatttgtttactgataggtttcattagtatgtttttgactttcaatttcttaaagaaaagcagaaaatttcattctttgtatcaagaggaaatggatgacgatctgaatgaaacctattatgtgcaaatgtatcggaatcttgagtttggaaccattgcttttaatattacaggtgtagcgattccattggctatttttatttcattaagtgaggtgattatattgcatacaaaccctcaaacatttttcctttctttcttactctttgtggtattcttagtcgctcaaaaatctctttttaaaaccattgcgattgttcgtcagtttgatttggaatttttcgctacaccaaaggatgtcttgaactatataaattcttatgatgaaggggagcgtcaggctaatttggaacagagttttcgaattttattccaattacaccaatatgtcttaccagccttatatatttttcttattatcatttctttcttgacaggagagattcagttactagctttcttgcttgtaggagccatccatgtttatatcaatgtgatgcagttacctatggtaaaacgttatttcaaataa

SEQ ID NO: 195 - DNA, 1866 bp, Streptococcus pneumoniae
atgaaaaaaactacaatattatcattaactacagctgcggttattttagcagcatatgtccctaatgaaccaatcctagcagatactcctagttcggaagtaatcaaagagactaaagttggaagtattattcaacaaaataatatcaaatataaggttctaactgtagaaggtaacataggaactgttcaagtgggtaatggagttactcctgtagagtttgaagctggtcaagatggaaaaccattcacgattcctacaaaaatcacagtaggtgataaagtatttaccgttactgaagtagctagtcaagcttttagttattatccagatgaaacaggtagaattgtctactatcctagctctattactatcccatcaagcataaaaaaaatacaaaaaaaaggcttccatggaagtaaagctaaaactattatttttgacaaaggcagtcagctggagaaaattgaagatagagcttttgatttttctgaattagaagagattgaattgcctgcatctctagaatatattggaacaagtgcattttcttttagtcaaaaattgaaaaagctaaccttttcctcaagttcaaaattagaattaatatcacatgaggcttttgctaatttatcaaatttagagaaactaacattaccaaaatcggttaaaacattaggaagtaatctatttagactcactactagcttaaaacatgttgatgttgaagaaggaaatgaatcgtttgcctcagttgatggtgttttgttttcaaaagataaaacccaattaatttattatccaagtcaaaaaaatgacgaaagttataaaacgcctaaggagacaaaagaacttgcatcatattcgtttaataaaaattcttacttgaaaaaactcgaattgaatgaaggtttagaaaaaatcggtacttttgcatttgcagatgcgattaaacttgaagaaattagcttaccaaatagtttagaaactattgaacgtttagccttttacggtaatttagaattaaaagaacttatattaccagataatgttaaaaattttggtaaacacgttatgaacggtttaccaaaattaaaaagtttaacaattggtaataatatcaactcattgccgtccttcttcctaagtggcgtcttagattcattaaaggaaattcatattaagaataaaagtacagagttttctgtgaaaaaagatacatttgcaattcctgaaactgttaagttctatgtaacatcagaacatataaaagatgttcttaaatcaaatttatctactagtaatgatatcattgttgaaaaagtagataatataaaacaagaaactgatgtagctaaacctaaaaagaattctaatcagggagtagttggttgggttaaagacaaaggtttatggtattacttaaacgaatcaggttcaatggctactggttgggttaaagacaaaggtttatggtattacttaaacgaatcaggttcaatggctactggttgggttaaagacaaaggcttatggtactacttaaatgaatcaggttcaatggctactggttgggttaaagacaaaggcttatggtattacttaaacgaatcaggttcaatggctactggttgggttaaagacaaaggcttatggtactacttaaatgaatcaggttcaatggctactggttgggttaaagacaaaggcttatggtattacttaaatgaatcaggttcaatggctactggttgggttacagtttctggtaaatggtactatacctataattcaggagatttattagtaaacacgactacacccgatggctatcgagtcaatgctaacggtgagtgggtaggatag

SEQ ID NO: 196 - DNA, 1185 bp, Streptococcus pneumoniae
atagatagcgcggaggcgcaggaggaaaattatatggctatattttatgttccggcagtcaaccttattggaaaaggtgttgtaaatgaagtgggtccttatatcaaggaacttggctataaaaaggcacttttggtgacagataagtacatcgaaggcagtgatattttacctaagactttaaaaccactggatacagaaggaatcgaatatgtcatctttagcgatgtagagccaaaccctacttgtaaaaatgtcacagatggggtagctgctttgcaagaacatggctgtgactttatcatcagtcttggcgggggttctccacaggatgcagctagttgtatttctatcatggctacaaatggtggaaaaccacaggattatgaagggcttcataagtctgctaaaaaaggcttgccagttgtggctatcaatacaacggcaggtacatcagcagaaattaccattaactatgtgattactgatgaagaacgcaaggttaagatggtaatggttgacaagaatagccttgctcttatctctgttaatgaccctgaactcatgctttccaaacctaaaggcctgactgctgctactggtatggatgctctgactcatgctgttgaagctttggtaacacctggtgcttatgatgtaaccaagaaactgtctattggtgctattgagcttatcaaggaatatcttcctcgtgctgtagaaaatggacatgatattgaagcgcgtgaaggtatggtcaatgccatcttccttggtggtatgagctttaataatgctggtcttggctatgttcactcaatggctcaccaactcggtgcagtatataatttgccacatggcgtgtgctgtgccatgttgctaccagttatagaacgtgaaaatgctaaacgtgtaccagaagctttccgcaatgttgccaaagccttgggacttcatgtagaaggtaaatcagatcaagaatgtgccgattatgcgattgctgagattgagaagctttctgagacagtaggtattcctaagaaactgactgaacttggtattgaagaaaaagatttcgactttgaatacctttctaagaatgccttgattgatgcctgcgcaccaggaaatccatttatgccaaccttagaagaaacgattgccttttataaagagttattttag

SEQ ID NO: 197 - DNA, 783 bp, Streptococcus pneumoniae
gaggagcttatgataaaagatgaacgtgtacttgaattgattgaaattatcaaaaagaaaaaaagaattgccgtaaaagagctggcagaaatcactttctccagcacaagtaccttacgtcgtgatttaattttcttagaaaatcaaggtcttatcaaaagaaagcacggatacgtgaccctgtcctctatgaacacaattgaactttctcatcaaatacgtgaaggagaaagtactaggcaaaaaagactaatcgctagtctcgctaaagactttattcggtctggtatgtgtatctatctagattctagtactactgtctacgaactctgtccctatctttctgaacttgataatttgattatttttacaaatggtttacatactgcacaaaccctatctgaaactgttaaagatagctccaaaatctttatcacatctggcgaggtcaaacatcaatcctgttccgtggtcaactatgataaggaaaattctttattagatcattttaatatcgatttagcattttgttcagcaagaggtattgatgaccaatatgtttatgaagcttctctcagccaagctatttcaaaaaagaatattattgacaaagcccatgaaaccatcttactgattgatagttctaaattttacaagactggattttttaaaattaatcccctctccaaatacacaacctttatttcagacaccgtgccagatcaaaaattattagacgcagtcgaattatttgatggagaatgggtttctgatattcaatga

SEQ ID NO: 198 - DNA, 870 bp, Streptococcus pneumoniae
tccgtaaccaagactcgccatggcgttgtttcaatgttcatgagaatggccaggaggtgggccatgcttagtttattatcttacgactttatacaacgcgcctttttggcggttattgctatgagtcttttctcaccggtattgggaaccttcctcatcttgcgtcgtcagagtttgatgagtgatacccttagccacgtctcactttcaggtgtagcctttggtctggttttggggatttctccaactgtttctactattgccattgtcttgattgcggcggtctttctggagtatctccgtacggtttacaagagctttatggaaatcgggacagctatcctcatgtcaacaggtctggctgtttctctgattgtcatgagcaagggtaaaagctcgagttcaatgagtttggaccaatatctctttggttcgatcgtgactatcagtgaagaacaggtcatttccctctttgtcattgcggcggttgttttgattttgacctttctctttcttcgtcctatgtatatcttaacttttgacgaagatacggcctttgtggatggcttgccagttcgtaccatgtccattctttttaacatggtgacaggggtggctattgcccttatgattcctgcagcaggagctcttctggtatcgaccattatggtcttgccagctagtattgccctgcgtctggggaaaaactttaaatcggttatgctgcttgccagtgcgattggctttttgggaatggtagcaggactttacatttcctactatgcagaaacacctgcaagtgcaagtattaccattatttttgtaactgtctttatactaatcagtttagtaagacgttttatcaaatag

SEQ ID NO: 199 - DNA, 756 bp, Streptococcus pneumoniae
acaaaaagtgattcagcggtttttgactgctttagtaggagaaatcaaataatgagatatattacggtagaggatttgtccttctattatgataaggagcctgttcttgaacatatcaattattgtgttgatagtggggaatttgttaccttgactggggaaaatggagcggctaagacgacgctcatcaaggctagtcttggaattctgcaaccacgcattggaaaggtggctatttcaaagacaaatacgcaaggtaagaaattgagaatagcctatcttcctcaacaaattgccagttttaatgctggttttccaagtacggtctatgaatttgtcaagtcgggtcgctatccgagaaaaggctggttccgtcgtttgaatgctcatgatgaggagcatatcaaggctagtctggactcagttggcatgtgggaacatcgagacaaacgcttggggtctctatctgggggacaaaagcagcgagcggtaattgcgcgtatgtttgcttctgaccctgatgtgtttatcctagacgagccgacaacggggatggatgcaggaagtaaaaatgaattttacgaactcatgcaccacagcgcccatcatcatggcaaggctgttttgatgattacccatgaccctgaagaagttaaggattatgcggatcgcaatattcatctagtccgtaaccaagactcgccatggcgttgtttcaatgttcatgagaatggccaggaggtgggccatgcttag

SEQ ID NO: 200 - DNA, 1566 bp, Streptococcus pneumoniae
aggagaatccctattgtgtcaaataaaccaatagcagatatgattgaaaccattgagcattttgctcagacacagcctagctatcctgtctataatgttttggggcaggaacacacttatggcgatttaaaggctgattcggatagtttggctgcagtcattgaccaactaggcttgcctgagaagtctcctgtggttgtttttggtggccaagaatatgaaatgttggcaacctttgtagcgctgactaagtcaggtcatgcctacattccaattgatagccattcggccttggagcgagtttcagctattttagaagtagcagagccaagcttgattattgccatttcagcctttcccttggagcaggtttctacaccaatgataaatctagctcaggttcaagaagcctttgcccaagggaataactatgaaatcacgcatccagtcaagggagatgataattactacattatctttacttctggtacgactggtaagcctaagggagtgcagatttcacatgataatctcctcagctttacaaactggatgattacggataaggaatttgcgacaccgagtcgtccgcaaatgctggcacagccaccttattcttttgacttgtctgtcatgtattgggcaccgaccttggcacttggtggtacgcttttcactcttccttcagtcatcactcaggactttaagcaactctttgcggctatcttttcattgccaatcgctatctggacatcaacaccatcctttgcagatatggccatgttgtctgaatacttcaacagtgagaaaatgcctggaatcacgcatttctactttgatggtgaagaattgacggtcaaaacagctcaaaaactgcgcgagcgtttcccaaatgcccgtatcatcaatgcttacggcccaacagaagcgacagtagctctgtcagcagttgccgtgacagacgagatgttagcgactctcaaacgcctaccaatcggctataccaaggctgattctccaacctttatcattgacgaggaaggaaataaactgccaaatggtgagcagggagaaatcattgtttctgggccagctgtttcaaaaggttatatgaacaatcctgaaaaaacagcagaagccttctttgagtttgaagatctgccagcctatcacacaggcgatgtgggaaccatgacagatgagggcttgcttctctacggcggacgcatggacttccagattaagtttaacggttaccgcattgagttagaagatgtctctcaaaacctcaacaagtctcgctttatcgaatctgctgtcgcagtaccgcgctataacaaggaccacaaggtacaaaatctattggcttatgtcatcttaaaagacggtgttcgtgagcagtttgagcgagatatcgatattaccaaggccatcaaggaagacctgacagacatcatgatgtcctatatgatgccatctaaattcctttaccgagacagtttgccactaactccaaatggaaagattgacatcaaaggattgattaacgaggtgaataagagatga

SEQ ID NO: 201 - DNA, 450 bp, Streptococcus pneumoniae
gtggatagtggattagacctagagaaatttttcgatacagttcctcaagatagattgatgtccttagtacataacattatcgaagacggagatacggaatccttgattcgtaagtatcttcattcaggtgttatcattaatggtcaacgttataaaacactagttggtacaccacagggaggaaatttatctcctctcttatccaatatcatgcttaatgaattggacaaggaattagaaaagaggggacttcgatttgtgcgctacgcagatgattgtgtgattacggtcggaagcgaggcagcctctaagcgtgtgatgtattcagtcagtcgttttattgagaaacggctaggtttgaaagtaaacatgaccaagagagttgaaatatctaggttttgggttctggaaattatcagatggttggaaaagccgtccacatcaagatag

SEQ ID NO: 202 - DNA, 429 bp, Streptococcus pneumoniae
gaaaggaatacgcacatgtcaaaactgctagataagatattatcacgcgaaaatatgctggaagcctacaatcaagtaaaatccaataaaggctcagctgggattgatggaatgactatcgaagagatggataattatctcagacaaaactggcgcttgactaaggaactgataaaacagagaaaatataagcctcaaccagttcttagagttgagatacctaaaccagacggaggcatccgtcaactaggaattccaacagttatggatagaatgattcaacaggccattgtccaagtcatgagccccatttgtgaaccccatttctcagatacgagttatggtttcagaccaaataggtcatgtgaaaaagccatcatgaagctcttagaatacttaaatgacggctatgagtggatagtggattag

SEQ ID NO: 203 - DNA, 528 bp, Streptococcus pneumoniae
tgtagatgtgatagaattagtggggaattcataatgagacagttgaagcgagttggagtatttttattgcttcctttctttgttctaattgacgcccatattagccagcttctgggctcatttttcccccatgtacatttggctagtcattttctttttctatttctcttatttgagacgatagaagtatcagagtatctctacctagtctattgttttgttataggcttggtttatgatgtttactttttccatctaatagggattacaactctcttatttatcttattgggagccttccttcataaattgaatagtgttattttgttgaatcgttggacaagaatgctagctatgattgtgctgacattcctgtttgaaatgggtagttatcttttggcttttatggtagggttgacagtagatagcatgtcgatttttatagtctatagcttggtaccgacgatgattttaaattttttatggattactgtttttcaatttatttttgaaaaatattatctataa

SEQ ID NO: 204 - DNA, 1323 bp, Streptococcus pneumoniae
tgtgaaactacaagcgatttactttatggaaggaatagaatgacaaaggttgtttttgaagaaaaatactatccagctgtaaaagaaatggtttatcgaactcgtttggccaacggattgacagttgctcttttgcctaaaaaggaatttaaagaggtttacgggagtgtcactgtacagtttggttcggtagatacgtttgtcacagaagttgacggagatgtaaaacaatatcctggaggaattgctcattttcttgaacataaattatttgagagagaagattctagtgatttgatgtcggcttttacgagtctaggtgcagatagtaatgcctttacaagctttacaaaaacaaactatcttttttcagcaacggattattttttagaaaatttagatttacttgatgaattggtaacatcagcacactttactgaagcttccattctgacagagcaggatattattcagcaagaacgagaaatgtaccaagatgatccagattcgtgtttattcttttcaactttagcgaatttgtatcctggtacacctttagcaactgatatagttggaagtgaggagtccatttcccaaatcaatctaactaatttgcaagaaaattttacaaagttttacaaacctgtaaacatgtctctgtttttagttggtaattttgatgtggagcgagtacaggactattttgaaagcaaagaactgaaagattcagattttcaggaagtagcaagagaaaagttgtttttacagcctgtaaagccaacagatagtatgagaatggaagtatcttctcccaaactagcgattggagttagaggtaagcgagaagtttctgaagcggattgctatcgacatcatattttattaaaattattgtttgcaatgatgtttggttggacttcggatcgttttcaaaaatgttatgaatcaggtaaaattgatgcgtccttatctctggaagttgaaataacaagtcgctttcattttgtcatgttgacaatggatacgaaagagccagttgctttgtctcatcaatttaggaaggctattcgtaattttacaaaggatttagatattacagaggaacatttagatattatcaaaagagagatgtttggcgaatttttcagtagcatgaactctcttgaatttattgcaacgcaatatgatgcttttgaaaatggtgagataatttttgatttgccgaaaattttacaggaaattactttagaggatgtccttgatgctggacatcatttaatagatgatggtgacatagttgattttacaatattcccatcgtag

SEQ ID NO: 205 - DNA, 1650 bp, Streptococcus pneumoniae
atatattacacatataggagaaaaacattgcttacagtatctgatgtttcactacgttttagtgatcgcaaactttttgatgatgtcaatatcaaatttacagaaggaaatacttacggattaatcggtgctaatggtgccggaaaatcaacctttttaaaaattttagctggagatatcgaacctactactggtcacatctctcttggtccagatgaacgtctctctgttcttcgtcaaaatcactttgactacgaagatgaacgtgccattgatgtcgttatcatgggaaatgaaaaactttatagcatcatgaaagagaaagatgctatctacatgaaggaagatttctcagacgaggacggggttcgtgctgccgaactcgaaggagagtttgccgaacttggaggttgggaagcagagagtgaagcctctcaactacttcaaaacctaaacattccagaagaattacactaccaaaacatgagcgaattggccaacggtgaaaaagtaaaggttctcctcgccaaagcactttttggtaaaccagatgttcttctcttggacgagcctactaacggtttggatatccaatcgattacttggttagaagacttcttgattgactttgataacacagttatcgtagtatcccacgaccgtcacttcttaaacaaagtttgtactcacatggccgaccttgactttggaaaaatcaaactctatgtcggaaactacgacttctggaaggaatcttctgagcttgctgctaaattgctagcagaccgtaatgctaaagcagaagaaaaaattaaacaattgcaagaatttgttgctcgtttctctgccaatgcttctaagtcaaggcaggcaacatcacgtaagaaaatgcttgataagattgagctagaagagattgtgccatctagtcgtaaatatccatttatcaactttaaagcggaacgtgagattggtaatgatctcttgacagtagaaaatttaactgtaaagattgatggtgaaactatcttggataatattagtttcatcttgcgtccagatgataagacagcacttattggacaaaatgatattcaaacgactgcattaattcgtgcaatcatgggagatattgactatgaaggaactgtcaagtggggagttacaactagtcaatcttacctaccaaaagataactcagctgattttgcaggaggagaatcaattcttgactggttgcgtcaattcgcaagtaaagaagaagatgacaatactttcctacgtggcttcctcggccgtatgctcttctctggagatgaagttaacaaacctgtaaatgtcttgtcagggggagaaaaagttcgtgtcatgctttcaaaactcatgctcttaaaatcaaatgtccttgtacttgatgatccaacaaatcacttggacttggaatctatctcaagcttgaatgatggattgaaaaactttaaagaatcaatcatctttgccagccatgaccacgaatttattcaaactttggctaaccatatcattgtcttatctaaaaatggcgtcattgaccgtatcgatgaaacctacgatgaattcctagaaaatgcagaagtacaagcaaaagttaaagaactttggaaagactaa

SEQ ID NO: 206 - DNA, 2586 bp, Streptococcus pneumoniae
ccaactgagttttctatcattctacgaggtaacatgaaatcatttttaaaaacatatcgaacctattttatttctttcatcattcctgtagtgattatgtctggagtatatctatctcaaagtatctactggaatagcgacaactctcctctattaggagatggctttcatcaatacgttatttttgatgtagccttacgaaatatcctacatggaaatagtaatctgttttacacctttacaagtggtctagggctaaacttctatgccctatctagttattacttgggtagttttctcgcgcctctggtttacttttttgatctaacgaatatgccagatgctatctatctgacaactctcttaaaatttggattgattggtctgtcaaccttttttagtttgaataaattgtttcaatctatccctcagattttaaaactagccttatctacttcctatgctctgatgagtttcactgtcagtcaattagagataaaaacctggctagatgtttttatcttgattcctttaattataactggtttacatctactgataactgaaaagaaactcctattgtactttacaagtctgtcaatcttatttattcaaaattattattttggatatatgacagtattgtttcttattttctggtatctctgtcaaatttcgtgggactttaagactcgaaaatcatctgttcttgatttcatagttatctcctttttagctggtatggctagtttgattatgactcttcccactctatttgatttacagacacatggggaaaaattgactgaagttacaaagtttcaaactgaaagtagctggtatcttgatctctttgctaagcaattcattggttcctttgacacaacaaagtatggggccatcccaatgatttttgttggactatttccctttattttgaccattttattttttacgctgaaatctattaagtttcacgtgaaactcatatatgtaatattctttgcatttctaattgcaagcttttacatagaagctcttgacttattttggcaaggcatgcatactccaaacatgtttttacatcgctatgcttggattttctctaccttgttaatttacacagcagcagaagtcttaaagcgtctgaaagaacttaaagtctggaattttttagtttcgctttttcttgtagtagcaggatttttagctaccatctatctaaaatcgcattattcttttttaacagatttgaatattctgcttactcttgaatttttggttgtctattctcttttactccttgcagttatcaaaaagtttatatctgtgaatctatttgccattctaatctctttatttatactggttgaaatgagtttaaatgcttcatctcaaatggacggaattgctaaggaatggggatttgcttctcgaagtgcttatagtcgagatatcccagctatggaatctttctcaacatatattggaaatcaatttactcgtactgaaaaactacaaactcagacaggaaatgacagtatgaaattcaactacaatggaatctctcaattttcatctgttcgaaatcgttcatcaagctctactttagataaacttggttttaaatcctctgggactaatctcaatctccgatatgcaaataatagtattttggctgatagtttatttggtatccagtacaatatctcagacagtcctattgataagtatggctttaaagatatctatcaaaaagataatcttaccctatatgaaaatcaatactctcttccgattgcagttgcgagtcaatctgtttacaatgatgtcaagttcaatgaacataccttggataatcaggcctcatttttaaatcaacttgctaacgtcaattttgattatttttctccaataccttatgaaaaaacagaaaaaatagaaaatactaatgatttgattagtgtcacaagttcttcaaatgaagatgcagcaatccagtatcaaattgaagttccagaaaacagccaagtttatctctctttcataaaccttcacttttctaacgataaacaaaagaaggttgacatccttgtaaatggtgaaaaaaagacttttacaactgataatgtcttctccttctttaatctaggatatactaaagagaaaaaaactttcaatatcaatgttagtttccctggaaattcacaagtatcatttgaatctcctaccttctatcgtttagataccaaaactttcaccgaggcaattcaaaaaattaaagaacaacctgtcacagtatcaacttctaaaaacaaggtttttgctacatatgatgtccaacaagatacatctattttcttcaccattccttatgacaaaggttggtctgcctaccaagatggtaagaaaatagaaattaaacaagctcaaactggatttatgaaagttgacattcccaaggggaaaggaactattacactttccttcattcccaatggttttattactggagcaatctgttcctttacttctctcttactatttggaatctataatcacagacgaaagtcatctaaggcataa

SEQ ID NO: 207 - DNA, 753 bp, Streptococcus pneumoniae
atgaaagttttaattttagaagatgttattgaacatcaagtgagactagagagaatattggatgaaatttcgaaagaatcgaatattccaatatcatacaagacaacgggaaaagtccgtgaatttgaagaatacattgaaaatgatgaagtaaatcagctttatttcctagatatcgatattcatggaattgagaaaaagggatttgaagtggctcagctcattcgtcattacaatccttacgctattatcgtctttatcactagtcgatcagagtttgcgactctaacctataaataccaggtatcagccctagattttgttgataaggatatcaatgatgagatgtttaagaagagaattgagcaaaatatcttctacacgaagagtatgttacttgaaaatgaagatgttgtagattatttcgactacaattacaagggaaatgatttaaaaattccttaccatgatattttgtatattgaaacaacaggggtatctcataaattgcgcattattggtaagaattttgcaaaagagttttatggtaccatgacagatattcaggaaaaggacaaacatactcagcgattttattctcctcacaagtcatttttggtaaatataggtaatatcagagaaattgatcgaaaaaacttagaaattgttttctatgaagaccatcgttgtcctatttcaagattaaaaattagaaaattaaaagatattttagagaaaaaatctcaaaagtga

SEQ ID NO: 208 - DNA, 1338 bp, Streptococcus pneumoniae
ggagaaagagtaatggatttacttggatttgggacagttattgttcattttttaattattagtcacagttaccgtttaatttgtaaaggtcgaataaatagaaaagaattatacgtttttggtgcttatacattactaactgaaatagtacttgaattttccttttatcttctatatttagataaaatagggattgaaagatttttatttcctttgggcttatattcctattttcgatggatgaaacagtatgagagggatagaggactattcctaagtttactactatctcttttatatgagagcactcataactttctgtccgtaattttctcctctataacaggagataattttgttttacaatatcatttcccattctttttcgttgtgacggtgttaacctattttgttacattaaaaatcatttactatttccatttggaactagcctattttgacaaggactacctttatcctttcttgaaaaaagtattttttgctttactattgctacatattgtatctttcgtttcagatatggtaagtacgattaaacatttgaatagttttggaagtattttgtcatctattgtctttatctctctccttttgaccttctttgcaatgaattctcataaagttcaaatggagaaagagattgctttgaagcagaagaaatttgaacagaaacatttacagaattacacagatgaaattgttggtctgtataatgaaatccgtggttttcgacatgattatgctggaatgcttgtcagcatgcagatggcaattgacagtggtaatttacaggaaattgacagaatttacaatgaagttttagtcaaagcaaatcataaattgcgttcagataagtacacttactttgatttgaacaacatagaagactcagctttacgaagtttggttgctcagtcaattgtctatgctcgaaataatggtgtagagtttacactggaagtaaaagatacgattaccaagcttccaattgaactattggatttggttcgtatcatgagcgttttattgaataatgctgtcgaaggatcggctgatagctataaaaagcagatggaagtagcagttattaagatggaaactgaaacagttattgtgattcagaattcatgtaaaatgacgatgactccttcaggagatctatttgccttaggattctccactaagggaagaaatcgcggagtcggattaaataatgtgaaagaactactagataagtacaacaatattattttagaaacagagatggaaggcagtacatttagacaaatcattagatttaagagggaatttgaatga

SEQ ID NO: 209 - DNA, 375 bp, Streptococcus pneumoniae
aagaaaatgtctaaaaatattgtacaattgaataattcttttattcaaaatgaataccaacgtcgtcgctacctgatgaaagaacgacaaaaacggaatcgttttatgggaggggtattgattttgattatgctattatttatcttgccaacttttaatttagcgcagagttatcagcaattactccaaagacgtcagcaattagcagacttgcaaactcagtatcaaactttgagtgatgaaaaggataaggagacagcatttgctaccaagttgaaagatgaagattatgctgctaaatatacacgagcgaagtactattattctaagtcgagggaaaaagtttatacgattcctgacttgcttcaaaggtga

SEQ ID NO: 210 - DNA, 1383 bp, Streptococcus pneumoniae
agatatagaaagaggtttgtcatcgcaaagaaaaaagcgacatttgtatgtcaaaattgtgggtataattcccctaaatatctgggacgttgccccaactgtgggtcttggtcttcttttgtggaagaggttgaggttgccgaagttaagaatgcgcgtgtgtccttgacaggtgagaaaaccaagcccatgaaactagctgaggtgacttccatcaatgtcaatcgaaccaagacggagatggaggaattcaaccgtgtgcttggaggcggagtggtaccaggaagtctcgtccttatcggtggggatcctgggattgggaaatcaactcttctcctacaagtctcaacccagttgtcccaagtggggacagttctctatgtcagtggggaggagtctgcccagcagattaaactacgtgcagagcgcttaggtgatattgatagtgagttttatctctatgcagagaccaatatgcagagtgttcgtgcagaagtggagcgtatccagccagactttctcattattgattccatccagaccatcatgtctcctgagatttcaggggtgcaggggtctgtttctcaggtgcgtgaagtgaccgctgaactcatgcagttggccaagaccaataacattgccatctttatcgtaggtcatgtgaccaaagaaggaaccttggctgggcctcgtatgttggagcatatggtggatacggtgctttactttgaaggggagcgtcaccacacctttcgtattttgagagcggtcaaaaatcgttttggttccactaatgagattgggatttttgagatgcagtcgggcggcttggttgaggtactcaatccgagtcaagttttcctagaagagcgtttggatggggcgactggttcctccatcgttgtaaccatggaagggacgcgtccgattttggcggaggttcaggctttggtaacaccgaccatgtttggaaatgccaagcgtactacgacaggacttgattttaaccgtgctagcttgattatggctgttttggaaaaacgggcagggcttctcttgcaaaatcaggatgcctatctcaaatctgctggtggtgttaaattggatgaacctgcgattgacttggctgttgcagttgctattgcttcgagctacaaagacaagccaactaatcctcaggaatgttttgtcggagaactgggcttgacaggagagattcggcgcgtgaatcgtattgagcaacgcatcaacgaagctgctaaactgggctttactaagatttatgtacctaagaattccttgacaggaatcactctgcctaaggaaattcaggtcattggcgtgacaacgattcaggaagtcttgaaaaaggtctttgcataa

SEQ ID NO: 211 - DNA, 753 bp, Streptococcus pneumoniae
aaccatctactatacggacggttcgaggtcaggtgcggaatatggactaatgggagtttctatctttctagctctcttttacatgattccggctctttattttctcttccgtattgggaaaaatgggaattgccaaagaaggttttgattctgtctttattgggagggatgttcctttcaggctggttgtctagttttgctaatacttatatccatgatttactgggggttcttttcccagatagtccatttttaaatgcctttgaaagtgctattgcggctcctttggtagaagaacccttgaaattattgtcacttgtttttgttttggctttgattcctgtgcgaaaattaaaatctttgtttttacttggaattgcttccggtttgggattccaaatgattaaggatattggttatattcgtacggatttgccagagggctttgactttactatttcgcgaattttagagcgtatcatctcaggaattgcctctcactggactttttcaggtctagctgtagtaggtgtttacttgctttacagagcctataaaggacagaaggttggcaagaaacagggccttatttttctaggtttagccttgggaactcacttcttgtttaactctccttttgtggagttggaaacagagttgcctttagcgattccagtggttacggctattgctctctatggtttttatcatgcttattgctttgttgagaaacacaatgagttgatgacctag

SEQ ID NO: 212 - DNA, 2187 bp, Streptococcus pneumoniae
ttttcattgagtattagggaaaaggagatgaatatgaaatttgggaaacgtcattatcgtccgcaggtggatcagatggactgcggtgtagcttcattagccatggtttttggctactatggtagttattattttttggctcacttgcgagaattggctaagacgaccatggatgggacgacggctttgggcttggtcaaggtggcagaggagattggttttgagacgcgagccattaaggcagatatgacgctttttgacttgccggatttaacttttccttttgttgcccatgtgcttaaggaagggaaattgctccactactatgtggtgactgggcaggataaggatagcattcatattgccgatccagatcccggggtgaagttgactaaactgccacgtgagcgttttgaggaagaatggacaggagtgactctttttatggcacctagtccagactataagcctcataaggaacaaaaaaatggtctgctctcttttatccctatattagtgaagcagcgtggcttgattgccaatatcgttttggcaacactcttggtaaccgtgattaacattgtgggttcttattatctgcagtctatcattgatacctatgtgccagatcagatgcgttcgacactagggattatttctattgggctagtcatcgtctacatcttccagcaaatcttgtcttacgctcaggagtatctcttgcttgttttggggcaacgcttgtcgattgacgtgattttgtcctatatcaagcatgtttttcacctccctatgtccttctttgcgacacgcaggacaggggagatcgtgtctcgttttacagatgctaacagtatcatcgatgcgctggcttcgaccatcctttcgattttcctagatgtgtcaacggttgtcattatttcccttgttctattttcacaaaataccaatctctttttcatgactttattggcgcttcctatctacacagtgattatctttgcctttatgaagccgtttgaaaagatgaatcgggataccatggaagccaatgcggttctgtcttcttctatcattgaggacatcaacggtattgagactatcaagtccttgaccagtgaaagtcagcgttaccaaaaaattgacaaggaatttgtggattatctgaagaaatcctttacctatagtcgagcagagagtcagcaaaaggctctgaaaaaggttgcccatctcttgcttaatgtcggcattctctggatgggggctgttctggtcatggatggcaagatgagtttggggcagttgattacctataataccttgctggtttactttactaatcctttggaaaatatcatcaatctgcaaaccaagcttcagacagcgcaggttgccaataaccgtctaaatgaagtgtatctagtagcttctgagtttgaggagaagaaaacagttgaggatttgagcttgatgaagggagatatgaccttcaagcaggttcattacaagtatggctatggtcgagatgtcttatcggatatcaatttaaccgttccccaagggtctaaggtggcttttgtggggatttcagggtcaggtaagacgactttggccaagatgatggttaatttttacgacccaagtcaaggggagattagtctgggtagtgtcaatctcaatcagattgataaaaaagccctgcgccagtacatcaactatctgtctcaacagccctatgtctttaacggaacgattttggagaatcttcttttgggagccaaggaggggacgacacaggaagatatcttacgggcggtcgaattggcagagattcgagaggatatcgagcgcatgccactgaattaccagacagaattgacttcggatggggcagggatttcaggtggtcaacgtcagagaatcgctttggcgcgtgctctcttgacagatgcgccggtcttgattttggatgaggcgactagcagtttggatattttgacagagaagcggattgtcgataatctcattgctttggacaagaccttgattttcattgctcaccgcttgactattgctgagcggacagagaaggtagttgtcttggatcagggcaagattgtcgaagaaggaaagcatgctgatttgcttgcacagggtggcttttacgcccatttggtcaatagctag

SEQ ID NO: 213 - DNA, 960 bp, Streptococcus pneumoniae
atggatatcaaaataaaaagggaggaaattatgaaaaagttttcaaaaacattgagagacaactggatctttctcttgatggttttgccaggggcactctggttgattctattcttttacattccagtatttgggaacgtggttgccttcaaagactaccacatgaccagtaatggtttcatagatagtatcataaatagtaaatgggtcggactcgataattttagattcttatttagttcaagagacgcctttattatcacacgaaatactgtcctctacaatcttggctttatctttctaggtttagttgtatctgtagggattgccattatcctcagcgagctccgttctaagagaatggtgaagatttttcaaacttctatgttgttcccttacttcttgtcttgggttatcatcagtttctttacagatgccttcctaaatattgataaaggggtgttcaatcatctattggaaagtcttggtctcaaagaagtcaatttctacgctgacctgggcatctggccctatctcctacttttcctaggtatttggaaaggctttggatatagcagtgtcatgtactatgcgacgatcatgggaattgatccaacctactacgaagcagcgacagtggacggagctagcaagtggcaacgtattcgcaacgtaaccattcctcagttgactccgcttgtaactgtattgaccatccttgcagtcggaaatatcttccgcgcagacttcggtctcttctatcaaatcccacacaatgctggtcagctttacaatgtaaccaacgttttggacgtatatgtctttaatggtttgactcagacagcagatatcggtatggctgcagcagccggtctttaccaatccgttgttggtttgattctggttatcctatcaaacttgcttgcaagacgagtcgatccaaactcagctttgttctag

SEQ ID NO: 214 - DNA, 1179 bp, Streptococcus pneumoniae
aagaggtattatatgaaaaagcaatcactcttttttgttccaggtattatcctgattggtgtttccttgcgaactccttttactgttttacccattattttgggaaatatttcgcaaggtctggaggtagaagttagttcgcttggtgtcttgaccagcctgcctctccttatgtttaccctcttttcaccattttctacccaactggctcagaaaatcggcttggagcatctcttcacctacagcctcttcttcttgaccatcggctcacttattcgactaatcaatctgcccctgctctatctaggaaccttgatggttggggcaagtgtcgcagtcatcaatgtcctgcttcctagtcttatccaagccaatcaaccaaagaaaattggttttctgaccaccttatatgtaacgtctatggggattgcaacggctctggcttcctatctagctgtgcccattacacaagccagttcttggaaaggacttatccttctcctcacgttactctgtctagcaacttttttggtctggctcccaaatcaccgctataatcatagactagctccacaaaccaaacaaaaaagtcaaataaaggtcatgcgtaataaacaggtttgggcaattattatcttttcaggttttcaatccttgatcttttacaccgtcatgacctggttacctaccatgtctatccatgcaggtctatccagtcacgaagctggcttgctgacttctatcttatctctgattagcattcctttttcaatgaccatcccaagcctgacaaccagtttatctactcgcaaccgtcagctcatgctcactctggtttcactagctggtgtggtcggcatttccatgctctttttcccaatcaataatttcatttactggcttgccatccatctcctcatcggaaccgcaaccagtgccctcttcccttatctcatggtcaacttttcactcaagacaagcgcccctgaaaagacagcccaattgtccggcctatctcaaacaggaggctatatcctagcagcctttgggccaaccctctttggttacagttttgacctgttccactcttgggtaccatctgtagctgccctcttgctcatcgatatcctgatgactgtggccctctttacagtggacagagcggataagatcctttaa

SEQ ID NO: 215 - DNA, 453 bp, Streptococcus pneumoniae
ttggatttcctctttgctgctggtgcctttggactagtcatcgcaaacaatgcctccatctcaggtgctgagggtgggtgtcaagctgaagttggttcagcctctgctatgagtgctgccgccttgactctggctgcaggtggaacaccttatcaggccagtcaagctattgcctttgtcattaaaaatatgctaggcctcatctgtgaccctgttgcaggtttggtcgaagttccctgtgtcaaacgtaatgccatgggagctagctttgctttcatcgcagcagacatggccttggcaggtatcgaatctaaaatccctgtggatgaagtgatcgatgccatgtaccaagtaggagcaagcatgccaactgcctttcgtgaaacagctgaaggtggactcgctaccacccctactggtcgtcgcctccaaaaagaaattttcggagaataa

SEQ ID NO: 216 - protein, 197 aa, Streptococcus pneumoniae
MHLTHREVRDKLLSYSEGLQVHYELYQLLLFHFQEKNADHFFGLIEQELPTVHPLFQTVFWTFLRDRDKIINALKLPYSNAKLEATNNLIKIIKRKAFGFRNFNNFKKRILMTLNIKKESTNFVLSRLQLFAYPLHLTKSHSLFHGIKGKTWFGIEVPACEVFFVPLADAGIGNHTCIVSAESQRGDDNLDICDFGC

SEQ ID NO: 217 - protein, 218 aa, Streptococcus pneumoniae
MPTALGYVSIGLACGIIGAPYVTPVEMGLMSLFVYAGSAQFAMLALIVVQAPVAAIAMTVFLINLRLFLLSLHASTYFRHTSLWYNIGMSSILTDETYGVLMGELAHTDKVNPMWMHGNNLNSYVAWFVGTVVGTALGGLLPNPEIFGLDFALVGMFIGIFASQFQIMQRRIPVRNLLIILAVVAVSFFLLLTVMSQSLAVLFATLLGCSMGVVLDGQ

SEQ ID NO: 218 - protein, 276 aa, Streptococcus pneumoniae
MKKIVKYSSLAALALVAAGVLAACSGGAKKEGEAASKKEIIVATNGSPKPFIYEENGELTGYEIEVVRAIFKDSDKYDVKFEKTEWSGVFAGLDADRYNMAVNNLSYTKERAEKYLYAAPIAQNPNVLVVKKDDSSIKSLDDIGGKSTEVVQATTSAKQLEAYNAEHTDNPTILNYTKADLQQIMVRLSDGQFDYKIFDKIGVETVIKNQGLDNLKVIELPSDQQPYVYPLLAQGQDELKSFVDKRIKELYKDGTLEKLSKQFFGDTYLPAEADIK

SEQ ID NO: 219 - protein, 457 aa, Streptococcus pneumoniae
MVFPSEQEQIEKFEKDHVAQHYFEVLRTLISKKSVFAQQVGLKEVANYLGEIFKRVGAEVEIDESYTAPFVMAHFKSSRPDAKTLIFYNHYDTVPADGDQVWTEDPFTLSVRNGFMYGRGVDDDKGHITARLSALRKYMQHHDDLPVNISFIMEGAEESASTDLDKYLEKHADKLRGADLLVWEQGTKNALEQLEISGGNKGIVTFDAKVKSADVDIHSSYGGVVESAPWYLLQALQSLRAADGRILVEGLYEEVQEPNEREMALLETYGQRNPEEVSRIYGLELPLLQEERMAFLKRFFFDPALNIEGIQSGYQGQGVKTILPAEASAKLEVRLVPGLEPHDVLEKIRKQLDKNGFDKVELYYTLGEMSYRSDMSAPAILNVIELAKKFYPQGVSVLPTTAGTGPMHTVFDALEVPMVAFGLGNANSRDHGGDENVRIADYYTHIELVEELIRSYE

SEQ ID NO: 220 - protein, 204 aa, Streptococcus pneumoniae
MGRFLDFVFNRFFLGMIATAFFWLLTLAGGIILGLAPASATLMSLYAEHGYSFREYSLKEAWSLYKQNFVSSNLIFYSFLGVGLVLTYGLYLLVQLPHQTIVHLIATLLNVLVVALIFLAYTVSLKLQVYFALSYRNSLKLSLIGIFMSLAAVAKVLLGTVLLVAIGYYMPALLFFVGIGMWHFFISDMLEPVYEIIHEKLATK

SEQ ID NO: 221 - protein, 152 aa, Streptococcus pneumoniae
MKKQVFHDAATGVLIGLILSILFSLIYAPNTYAPLNPYSLIGQVMDQHQVHGALVLLYCTLIWATIGMLFNFGNRLFSRDWSMLRATLTHFFLMLAGFVPLATLAGWFPFHWIFYLQLIIEFAIVYLIIWAILYKREAKKVDHINQLLEHRK

SEQ ID NO: 222 - protein, 197 aa, Streptococcus pneumoniae
MYAYLKGIITKITAKYIVLETNGIGYILHVANPYAYSGQVNQEAQIYVHQVVREDAHLLYGFRSEDEKKLFLSLISVSGIGPVSALAIIAADDNAGLVQAIETKNITYLTKFPKIGKKTAQQMVLDLEGKVVVAGDDLPAKVAVQASAENQELEEAMEAMLALGYKATELKKIKKFFEGTTDTAENYIKSALKMLVK

SEQ ID NO: 223 - protein, 189 aa, Streptococcus pneumoniae
MKKIVLVSLAFLFVLVGCGQKKETGPATKTEKDTLQSALPVIENAEKNTVVTKTLVLPKSDDGSQQTQTITYKDKTFLSLAIQQKRPVSDELKTYIDQHGVEETQKALLEAEEKDKSIIEARKLAGFKLETKLLSATELQTTTSFDFQVLDVKKASQLEHLKNIGLENLLKNEPSKYISDRLANGATEQ

SEQ ID NO: 224 - protein, 152 aa, Streptococcus pneumoniae
MKLKRFTLSLASLASFSLLVACSQRAQQVQQPVAQQQVQQPAQQNTNTANAGGNQNQAAPVQNQPVAQPTDIDGTYTGQDDGDRITLVVTGTTGTWTELESDGDQKVKQVTLDSANQRMIIGDDVKIYTVNGNQIVVDDMDRDPSDQIVLTK

SEQ ID NO: 225 - protein, 510 aa, Streptococcus pneumoniae
MKYRKFQLLMSKYGFSLSIMLLELCLVFGLFLYLGRMAPILWITVLILLSIITIISIVNRNTTPENKVTWLLVAFVPVFGPLLYLMFGERRLSKKEIKQLKKLGSMHFQEANSQLLKEKLKESDKAAYGVIKSLLSMDTNADIYDQTASTFFPNGEAMWKKMVEDLKKAEKFIFLEYYIIEEGLMWNRILDILEQKVAQGVEVKMLYDDIGCMATLTGDYAHRLRQLGIEAHKFNKVIPRLTVAYNNRDHRKILIVDGQIAYTGGVNLADEYINHVERFGYWKDSGIRLDGLAVKALTRLFLTTWYINRGEISDFDQYHLENHSIPSDGLTIPYGSGPKPIFRAQVGKKVYQSLINQATESVYITTPYLIIDYDLTETIKNAAMRGVDVRIITPYIPDKKFIQLVTRGAYPDLLSAGVRIYEYSPGFIHSKQMLVDEDFAVVGTINLDYRSLVHHYENAVLLYKTPSIREIARDFRNIFADSQEVYPHSIKTSWYQKLVKEIAQLFAPIL

SEQ ID NO: 226 - protein, 81 aa, Streptococcus pneumoniae
MNQTFGTVVSNDWFSLSNINIQTTFYCLRLIIFTLVVIFFFIVNWWVKDLVESFSSYAVDDTPTQTFQKAVRVHFNIDNTF

SEQ ID NO: 227 - protein, 490 aa, Streptococcus pneumoniae
MINDIILLLFVKIKRRLMMDKLFKLKENGTDVRTEVLAGLTTFFAMSYILFVNPQILSQTGMPAQGVFLATIIGAVAGTLMMAFYANLPYAQAPGMGLNAFFTFTVVFGLGYSWQEALAMVFICGIISLIITLTNVRKMIIESIPNALRSAISAGIGVFLAYVGIKNAGLLKFTIDPGNYTVVGEGADKAQATIAANSSAVPGLVSFNNPAVLVALAGLAITIFFVIKGIKGGIILSILTTTVLAIAVGLVDLSSIDFANNHVGAAFEDLKTIFGAALGSEGLGALVSDTARLPETLMAILAFSLTDIFDTIGTLIGTGEKVGIVATNGENHQSAKLDKALYSDLIGTTVGAIAGTSNVTTYVESAAGIGAGGRTGLTALVVAICFAISSFFSPLLAIVPTAATAPILIIVGIMMLGSLKNIHWDDMSEAVPAFFTSIFMGFSYSITQGIAVGFLTYTLTKLVKGQVKDVHVMIWILDALFILNYISMAL

SEQ ID NO: 228 - protein, 1077 aa, Streptococcus pneumoniae
MILQYVYWSVYMQTKTKKLIVSLSSLVLSGFLLNHYMTIGAEETTTNTIQQSQKEVQYQQRDTKNLVENGDFGQTEDGSSPWTGSKAQGWSAWVDQKNSADASTRVIEAKDGAITISSHEKLRAALHRMVPIEAKKKYKLRFKIKTDNKIGIAKVRIIEESGKDKRLWNSATTSGTKDWQTIEADYSPTLDVDKIKLELFYETGTGTVSFKDIELVEVADQLSEDSQTDKQLEEKIDLPIGKKHVFSLADYTYKVENPDVASVKNGILEPLKEGTTNVIVSKDGKEVKKIPLKILASVKDAYTDRLDDWNGIIAGNQYYDSKNEQMAKLNQELEGKVADSLSSISSQADRTYLWEKFSNYKTSANLTATYRKLEEMAKQVTNPSSRYYQDETVVRTVRDSMEWMHKHVYNSEKSIVGNWWDYEIGTPRAINNTLSLMKEYFSDEEIKKYTDVIEKFVPDPEHFRKTTDNPFKALGGNLVDMGRVKVIAGLLRKDDQEISSTIRSIEQVFKLVDQGEGFYQDGSYIDHTNVAYTGAYGNVLIDGLSQLLPVIQKTKNPIDKDKMQTMYHWIDKSFAPLLVNGELMDMSRGRSISRANSEGHVAAVEVLRGIHRIADMSEGETKQCLQSLVKTIVQSDSYYDVFKNLKTYKDISLMQSLLSDAGVASVPRPSYLSAFNKMDKTAMYNAEKGFGFGLSLFSSRTLNYEHMNKENKRGWYTSDGMFYLYNGDLSHYSDGYWPTVNPYKMPGTTETDAKRADSDTGKVLPSAFVGTSKLDDANATATMDFTNWNQTLTAHKSWFMLKDKIAFLGSNIQNTSTDTAATTIDQRKLESGNPYKVYVNDKEASLTEQEKDYPETQSVFLESFDSKKNIGYFFFKKSSISMSKALQKGAWKDINEGQSDKEVENEFLTISQAHKQNRDSYGYMLIPNVDRATFNQMIKELESSLIENNETLQSVYDAKQGVWGIVKYDDSVSTISNQFQVLKRGVYTIRKEGDEYKIAYYNPETQESAPDQEVFKKLEQAAQPQVQNSKEKEKSEEEKNHSDQKNLPQTGEGQSILASLGFLLLGAFYLFRRGKNN

SEQ ID NO: 229 - protein, 259 aa, Streptococcus pneumoniae
MSINVFQAILIGLWTAFCFSGMLLGIYTNRCIVLSFGVGIILGDLPTALAMGAIGELAYMGFGVGAGGTVPPNPIGPGIFGTLMAITSAGKVSPEAALALSTPIAVAIQFLQTFAYTVRAGAPETAMKHLKNHNLKKFKFTLNATIWLFAFIGFTLGCLGALSMDTLLKLVDYIPPVLLTGLTVAGKMLPAIGFAMILSVMAKKELIPFVLLGYVCAAYLNIPTIGIAIVGTIFALIEFYNKPKTADHVVEEEAHDDWI

SEQ ID NO: 230 - protein, 111 aa, Streptococcus pneumoniae
MKSLARLLIIHVFISIFLFFALTSGAISHTVLLLLLLFLPALNKGLEKIQSKRIPVLNAALFFLLISFPQLLTNPVQWKFSIFLVVTIISSLAYFYNFYQVVKEVDQKQLI

SEQ ID NO: 231 - protein, 750 aa, Streptococcus pneumoniae
MKWTKRVIRYATKNRKSPAENRRRVGKSLSLLSVFVFAIFLVNFAVIIGTGTRFGTDLAKEAKKVHQTTRTVPAKRGTIYDRNGVPIAEDATSYNVYAVIDENYKSATGKILYVEKTQFNKVAEVFHKYLDMEESYVREQLSQPNLKQVSFGAKGNGITYANMMSIKKELEAAEVKGIDFTTSPNRSYPNGQFASSFIGLAQLHENEDGSKSLLGTSGMESSLNSILAGTDGIITYEKDRLGNIVPGTEQVSQRTMDGKDVYTTISSPLQSFMETQMDAFQEKVKGKYMTATLVSAKTGEILATTQRPTFDADTKEGITEDFVWRDILYQSNYEPGSTMKVMMLAAAIDNNTFPGGEVFNSSELKIADATIRDWDVNEGLTGGRTMTFSQGFAHSSNVGMTLLEQKMGDATWLDYLNRFKFGVPTRFGLTDEYAGQLPADNIVNIAQSSFGQGISVTQTQMIRAFTAIANDGVMLEPKFISAIYDPNDQTARKSQKEIVGNPVSKDAASLTRTNMVLVGTDPVYGTMYNHSTGKPTVTVPGQNVALKSGTAQIADEKNGGYLVGLTDYIFSAVSMSPAENPDFILYVTVQQPEHYSGIQLGEFANPILERASAMKDSLNLQTTAKALEQVSQQSPYPMPSVKDISPGDLAEELRRNLVQPIVVGTGTKIKNSSAEEGKNLAPNQQVLILSDKAEEVPDMYGWTKETAETLAKWLNIELEFQGSGSTVQKQDVRANTAIKDIKKITLTLGD

SEQ ID NO: 232 - protein, 217 aa, Streptococcus pneumoniae
MSNGNRMKNGNRIYSWRLFMYGIIKRLGDILLSLIGIIILCPVFMIIAIAIKLDSEGPVIFKQKRFGIHKEYFYILKFRSMKIDAPKNVAPRNLYNPEQWITKVGAFLRKTSLDELPQLFNILVGNMSIVGPRPAGINELDLIAERDKYGANDILPGLTGWAQINGRDTLSVEMKTELDGYYVKHLSLIMDIRCIVKTIPYVLKRKGIVEGSGKKES

SEQ ID NO: 233 - protein, 409 aa, Streptococcus pneumoniae
MKILFVCQHYKPEPFRLSDICEDLVRKGHEVSVLAGIPNYPEGKIYADYRHNKKRREIIEGVTIYRSYTIPRKKSVVFRLLNYFSFAISSTLGVLLGRYKTKDGSNFDCVFVNQLSPVMMAWAGMAYKKKYKKPMFLYCMDVWPDSLTVGGVKQDGLIFKLFKFISKKVYRASDYIFVTSPSFKNYFVKQFDISEQKITYLPQYAEDLFIPDESIVNKESVDLTFAGNIGKAQNLETILKAASLIEKNTNLPKKIHFHFVGDGTELLSMKALAHELELKNISFYGRRSLEEMPSFYKKSDAMLVSLIGDSIVSRTIPGKVQSYMAAGKPIIGAISGDAKIIVEEANCGYVSPERDVKQLAKNICKFSMLSIKRQRELGKKARCYYENHFSKEQFMLELETCLERESKKE

SEQ ID NO: 234 - protein, 372 aa, Streptococcus pneumoniae
MIKVLHLFTTLDSGGVESFLFNYYSHIDRKKIQFDFIVPGKEQGFLEDKMKELGAKVYHVPLLRKKPLHQFLSLARIIKKGDYDIVHCHGYKSAIGLILSKIIGCKIRIIHSHMAYVTENSFQKVLRKLVTILVKILATHWFACGEDSAKWLYGEKAYKDGKIEIIFNAIDLKKYQFLSDVREKCRRELDVSNKFVLGNIARLSDQKNQSYLFNVLKELILIKPNVILLLVGNGEDEQKLKQKALELNLTPYVLFLGRRTDISDLLSAMDVFLLPSKYEGLPVSLVEAQASGLQILSSDTVTQEVDVTKNISYLPINEESVLLWKDKVLSLTSEECNRFEINNSMTDGLYDICYQASKLLNRYQEMCVIKEI

SEQ ID NO: 235 - protein, 413 aa, Streptococcus pneumoniae
MKVDRISFIKNTSSLYILNIVKLLFPLLTLPYLTRVLSLDAYGMVIYVKALIAYVQLVIDFGFMISATKNIVNACTTPSKIGRIVGDTLVEKIFLSIISILIYTILMWQIPIMRENILFSVFYLLATVTNIFIFDFLFRGIEKMHAVAIPYIISKTIITILTFIVVKDDSSILWIPILEGIGNLVAAVVSYRFLHYYGIKLSFSYLSVWVKDLKESSIYFLSNFATTIFGVFTTVISGFYLQSQEIAFWGIAMQLLSAAKSLYNPIANSLYPHMIRTKDIQSVKSINRIMFIPIIFGVLIVLFFSNQILSIIGGEKYTVSADFLKYLLPAFVASFYSMIYGWPVLGAIDKVKETTMTTILASIVQTLGLGIFILSDNFSLVTLAICSSMSEVVLWISRYLIYFKNRSLFVRSK

SEQ ID NO: 236 - protein, 1767 aa, Streptococcus pneumoniae
MNKGLFEKRCKYSIRKFSLGVASVMIGAAFFGTSPVLADSVQSGSTANLPADLATALATAKENDGRDFEAPKVGEDQGSPEVTDGPKTEEELLALEKEKPAEEKPKEDKPAAAKPETPKTVTPEWQTVANKEQQGTVTIREEKGVRYNQLSSTAQNDNAGKPALFEKKGLTVDANGNATVDLTFKDDSEKGKSRFGVFLKFKDTKNNVFVGYDKDGWFWEYKSPTTSTWYRGSRVAAPETGSTNRLSITLKSDGQLNASNNDVNLFDTVTLPAAVNDHLKNEKKILLKAGSYDDERTVVSVKTDNQEGVKTEDTPAEKETGPEVDDSKVTYDTIQSKVLKAVIDQAFPRVKEYSLNGHTLPGQVQQFNQVFINNHRITPEVTYKKINETTAEYLMKLRDDAHLINAEMTVRLQVVDNQLHFDVTKIVNHNQVTPGQKIDDESKLLSSISFLGNALVSVSSNQTGAKFDGATMSNNTHVSGDDHIDVTNPMKDLAKGYMYGFVSTDKLAAGVWSNSQNSYGGGSNDWTRLTAYKETVGNANYVGIHSSEWQWEKAYKGIVFPEYTKELPSAKVVITEDANADKNVDWQDGAIAYRSIMNNPQGWEKVKDITAYRIAMNFGSQAQNPFLMTLDGIKKINLHTDGLGQGVLLKGYGSEGHDSGHLNYADIGKRIGGVEDFKTLIEKAKKYGAHLGIHVNASETYPESKYFNEKILRKNPDGSYSYGWNWLDQGINIDAAYDLAHGRLARWEDLKKKLGDGLDFIYVDVWGNGQSGDNGAWATHVLAKEINKQGWRFAIEWGHGGEYDSTFHHWAADLTYGGYTNKGINSAITRFIRNHQKDAWVGDYRSYGGAANYPLLGGYSMKDFEGWQGRSDYNGYVTNLFAHDVMTKYFQHFTVSKWENGTPVTMTDNGSTYKWTPEMRVELVDADNNKVVVTRKSNDVNSPQYRERTVTLNGRVIQDGSAYLTPWNWDANGKKLSTDKEKMYYFNTQAGATTWTLPSDWAKSKVYLYKLTDQGKTEEQELTVKDGKITLDLLANQPYVLYRSKQTNPEMSWSEGMHIYDQGFNSGTLKHWTISGDASKAEIVKSQGANDMLRIQGNKEKVSLTQKLTGLKPNTKYAVYVGVDNRSNAKASITVNTGEKEVTTYTNKSLALNYVKAYAHNTRRDNATVDDTSYFQNMYAFFTTGADVSNVTLTLSREAGDQATYFDEIRTFENNSSMYGDKHDTGKGTFKQDFENVAQGIFPFVVGGVEGVEDNRTHLSEKHNPYTQRGWNGKKVDDVIEGNWSLKTNGLVSRRNLVYQTIPQNFRFEAGKTYRVTFEYEAGSDNTYAFVVGKGEFQSGRRGTQASNLEMHELPNTWTDSKKAKKATFLVTGAETGDTWVGIYSTGNASNTRGDSGGNANFRGYNDFMMDNLQIEEITLTGKMLTENALKNYLPTVAMTNYTKESMDALKEAVFNLSQADDDISVEEARAEIAKIEALKNALVQKKTALVADDFASLTAPAQAQEGLANAFDGNVSSLWHTSWNGGDVGKPATMVLKEPTEITGLRYVPRGSGSNGNLRDVKLVVTDESGKEHTFTATDWPNNNKPKDIDFGKTIKAKKIVLTGTKTYGDGGDKYQSAAELIFTRPQVAETPLDLSGYEAALVKAQKLTDKDNQEEVASVQASMKYATDNHLLTERMVEYFADYLNQLKDSATKPDAPTVEKPEFKLRSLASEQGKTPDYKQEIARPETPEQILPATGESQSDTALILASVSLALSALFVVKTKKD

SEQ ID NO: 237 - protein, 232 aa, Streptococcus pneumoniae
MRKFKIFLFIEACLLTGALILMVSEHFSRFLLILFLFLLLIRYYTGKEGNNLLLVAATILFFFIVMLNPFVILAIFVAVIYSLFLLYPMMNQEKEQTNLVFEEVVTVKKEKNRWFGNLHHFSSYQTCQFDDINLFRFMGKDTIHLERVILTNHDNVIILRKMVGTTKIIVPVDVEVSLSVNCLYGDLIFFNQPKRALRNEHYHQETKDYLKSNKSVKIFLTTMIGDVEVVRG

SEQ ID NO: 238 - protein, 79 aa, Streptococcus pneumoniae
MKKTVYKKLGISIIASTLLASQLSTVSALSVISSTGEEYEVSETLEKGPESNDSSLSEISPTYGSYYQKQSEVLSVMMI

SEQ ID NO: 239 - protein, 778 aa, Streptococcus pneumoniae
MNKKILETLEFDKVKALFEPHLLTEQGLEQLRQLAPTAKADKIKQAFAEMKEMQALFVEQPHFTILSTKEIAGVCKRLEMGADLNIEEFLLLKRVLLASRELQNFYTNLENVSLEELALWFEKLHDFPQLQGNLQAFNDAGFIENFASEELARIRRKIHDSESQVRDVLQDLLKQKAQLLTEGIVASRNGRQVLPVKNTYRNKIAGVVHDISASGNTVYIEPREVVKLSEEIASLRADERYEMLRILQEISERVRPHAAEIANDAWIIGHLDLIRAKVRFIQERQAVVPQLSENQEIQLLHVCHPLVKNAVANDVYFGQDLTAIVITGPNTGGKTIMLKTLGLTQVMAQSGLPILADKGSRVGIFEEIFADIGDEQSIEQSLSTFSSHMTNIVDILGKVNQHSLLLLDELGAGTDPQEGAALAMAILEDLRLRQIKTMATTHYPELKAYGIETAFVQNASMEFDTATLRPTYRFMQGVPGRSNAFEIAKRLGLSEVIVGDASQQIDQDNDVNRIIEQLEEQTLESRKRLDNIREVEQENLKMNRALKKLYNELNREKETELNKAREQAAEIVDMALSESDQILKNLHSKSQLKPHEIIEAKAKLKKLAPEKVDLSKNKVLQKAKKKRAPKVGDDIVVLSYGQRGTLTSQLKDGRWEAQVGLIKMTLEEKEFDLVQAQQEKPVKKKQVNVVKRTSGRGPQARLDLRGKRYEEAMNELDTFIDQALLNNMAQVDIIHGIGTGVIREGVTKYLQRNKHVKSFGYAPQNAGGSGATIVTFKG

SEQ ID NO: 240 - protein, 91 aa, Streptococcus pneumoniae
MSFLDKSNLGTNQVQMTDNPSVISNLSRMRADTLRNFLENAKHFIALICSQTSNFFAQFDYLTGFDIDGVSTSRNIMNDTCNLIAVGVFDW

SEQ ID NO: 241 - protein, 303 aa, Streptococcus pneumoniae
MEVRMKKLPLVFSGCLLGLAGAGNLILDTLPVLSHLFSLIGLVLWIYFLILHLFNWKETKQELTKPPLLSGMATFPMAGMILSTYVFRVFSYLPLVAQGIWWFSFLLDLTLIAGFTIKFACPGRRVHATPSWTVLYVGIAVAALTYPLVGIIEIAYATLSFGFLLTFYLYPLIYSDLKKHPLPLALLGQEGIYCAPFSLLLASLVRVGGTSLPTWVLIVMILASQSFFFFVLTRLPNILKQGFQPAFSALTFPTIITATSLKMAQGILKLPFLDYLVLAETIICLTILFFVLGAYLIWLRKKV

SEQ ID NO: 242 - protein, 281 aa, Streptococcus pneumoniae
MYLIEILKSIFFGIVEGITEWLPISSTGHLILAEEFIQYQNQNEAFMSMFNVVIQLGAILAVMVIYFNKLNPFKPTKDKQEVRKTWRLWLKVLIATLPLLGVFKFDDWFDTHFHNMVSVALMLIIYGVAFIYLEKRNKARAIEPSVTELDKLPYTTAFYIGLFQVLALLPGTSRSGATIVGGLLNGTSRSVVTEFTFYLGIPVMFGASALKIFKFVKAGELLSFGQLFLLLVAMGVAFAVSMVAIRFLTSYVKKHDFTLFGKYRIVLGSVLLLYSFVRLFV

SEQ ID NO: 243 - protein, 304 aa, Streptococcus pneumoniae
MLIKMVKTKKQKRNNLLLGVVFFIGMAVMAYPLVSRLYYRVESNQQIADFDKEKATLDEADIDERMKLAQAFNDSLNNVVSGDPWSEEMKKKGRAEYARMLEIHERMGHVEIPVIDVDLPVYAGTAEEVLQQGAGHLEGTSLPIGGNSTHAVITAHTGLPTAKMFTDLTKLKVGDKFYVHNIKEVMAYQVDQVKVIEPTNFDDLLIVPGHDYVTLLTCTPYMINTHRLLVRGHRIPYVAEVEEEFIAANKLSHLYRYLFYVAVGLIVILLWIIRRLRKKKKQPEKALKALKAARKEVKVEDGQQ

SEQ ID NO: 244 - protein, 297 aa, Streptococcus pneumoniae
MDNSRRSRKKGTKKKKHPLILLLIFLVGFAVAIYPLVSRYYYRIESNEVIKEFDETVSQMDKAELEERWRLAQAFNATLKPSEILDPFTEQEKKKGVSEYANMLKVHERIGYVEIPAIDQEIPMYVGTSEDILQKGAGLLEGASLPVGGENTHTVITAHRGLPTAELFSQLDKMKKGDIFYLHVLDQVLAYQVDQIVTVEPNDFEPVLIQHGEDYATLLTCTPYMINSHRLLVRGKRIPYTAPIAERNRAVRERGQFWLWLLLGAMAVILLLLYRVYRNRRIVKGLEKQLEGRHVKD

SEQ ID NO: 245 - protein, 441 aa, Streptococcus pneumoniae
MMNNILAFLETKVAPFGEKVGNQRHLKAIREGFMMAMPLILVGSLFLILISWPQEAFTNWLNSVGLLSILTTMNQSTVAIISLVACFGIAYRLSEGYGTDGPSAGIIALSSFVLMAPRFSSMVYDKNGEQVKQLFGGAIPFSSLNASSLFMAITIGLVTAEIYRMFIQRGITIKMPSGVPDVVSKSFSALLSGFTTFVLWALVLKGLEAAGVAGGLNGLLGAIVGTPLKLIAGTLPGMILCVIVNSFFWFCGVNGGQVLNAFVDPVWLQFTTENQEAVAAGQTLQHIITLPFKDLFVFIGGGGATIGLAICLFLFSKSRANKTLGKLAIIPSIFNINTAILFTFPTVLNPIMLIPFIATPTINALITYVSMAVGLVPYTTGVILPWTMPPIIGGFLATGASWRGALLQVVLILVSVAIYYPFFKIADKRNLEKEKATVGGK

SEQ ID NO: 246 - protein, 559 aa, Streptococcus pneumoniae
MDKLVAAIEKQQGKFEKISTNNYMMAIKDGFIATMPLIMFSSFLMIIIMIPKNFGVELPSPAIVWMRKVYMLTMGVLGIIVSGTVGKSLVGNVNRKMPHGKVINDISAMLAAICSYLVLTVTLVVDEKTGSTSLSTNYLGSQGLITSFVSAFITVNVYRFCIKRDITIHLPKEVPGAISQAFRDIFPFSFVLLISGLLDIVSRFSLDVPFAQVFQQLLTPIFKGAESYPAMMLIWFMCALLWFVGIHGPSIVLPAVTALQLSNMEENAQLLANGQFPYHSLTPNFGNYIAAIGGTGATFVVPFILIFFMRSKQLKSVGKATITPVLFAVNEPLLFGMPVILNPYLFVPFLMTPPVNVFLGKVFIDFFGMNGFYIQLPWTFPGPLGLLIGTNFQLISFVFLSLILVVDILIYLPFCRAYDRQLLVKEDIASSNDIILEEDTSEIIPGEIDEIKSKELKVLVLCAGSGTSAQLANAINEGANLTEVRVIANSGAYGAHYDIMGVYDLIILAPQVRSYYREMKVDAERLGIQIVATRGMEYIHLTKSPSKALQFVLEHYQAV

SEQ ID NO: 247 - protein, 560 aa, Streptococcus pneumoniae
MKEAIIEWKDFSFRYETQQEPTLQGIDLTIYKGEKVLIVGPSGSGKSTLGQCLNGIIPNIYKGQTYGEFLIKGQVAFDMSIYDKSHLVSTVLQDTDGQFIGLSVAEDLAFALENDVTALDEMKGRVYKWAEKLDLLPLLDQRPQDLSGGQKQRVSLAGVLIDESPILLFDEPLANLDPKSGQDIIELIDQIHKEEGTTTLIIEHRLEDVLHRPVDRIVLINDGRILFNGSPDQLLATDLLTQNGIREPLYLTTLRQLGVDLVKEEQLANLDNLSISKGQVQLQNELAKETPALQSLFRLEEVSFSYDDRPILKSLHLDIKKGEKIAIVGKNGAGKSTLAKAISSFIQTEGRYLWEKQDIKGDSVAERAERVGYVLQNPNQMISTNMIFDEVALGLRLRGVDEKEIETRVYETLKICGLYEFRNWPISALSFGQKKRVTIASILVLGAEIILLDEPTAGQDQKNYTEIMEFLEELHQKGHTIVMITHDMQLMLDYSDRVLVMVDGELIADTVPASLLSDPELLVKANLKETSIFNLAKKLDVDPLDLTAFYKERREGCKLN

SEQ ID NO: 248 - protein, 543 aa, Streptococcus pneumoniae
MSINWQEILFHFLGGLGLFLYSIKTMGDGLQQAAGDRLRFYIDKYTSNPFFGVLVGIGMTALIQSSSGVTVITVGLVSAGLLTLRQAIGIVMGANIGTTVTSFLIGFKLGNYALPMLFIGAVCLFFTKNRTVNNIGRILFGVGGIFFALNLMSGAMAPLKDLQVFKDYMIELSKNPVLGVFVGTGLTLLIQASSATIGILQNLYAGNLIDLQGALPVLFGDNIGTTITAIIASLGANIAAKRVAGAHVAFNVIGTVVCVIFLVPFTVLIHWFEATLNLAPEMTIAFAHGTFNITNTIVQFPFIGALAYFVTKIIPGEDEVVKYEPLYLDEHFIKQAPSIALGNAKKELLHLGNYAAKAFDLSYKYIIDLDEKVAEKGHKTEEAINTIDEQLTRYLIALSSEALSQKESEVLTNILDSSRDLERIGDHTEALLNLTDYLQRKNVEFSDAALKELEEVYRQTSDFIKDALDSVENNDIEKARSLVERHEAINKIERVLRKTHIKRLNKGECSTQAGVNFIDIISHYTRVSDHAMNLAEKVFAEQI

SEQ ID NO: 249 - protein, 1659 aa, Streptococcus pneumoniae
MKNPFFERRCRYSIRKLSVGACSLMIGAVLFAGPALAEETAVPENSGANTELVSGESEHSTNEADKQNEGEHARENKLEKAEGVAIASETASPASNEAATTETAEAASAAKPEEKASEVVAETPSAEAKPKSDKETEAKPEATNQGDESKPAAEANKTEKEVQPDVPKNTEKTLKPKEIKFNSWEELLKWEPGAREDDAINRGSVVLASRRTGHLVNEKASKEAKVQALSNTNSKAKDHASVGGEEFKAYAFDYWQYLDSMVFWEGLVPTPDVIDAGHRNGVPVYGTLFFNWSNSIADQERFAEALKQDADGSFPIARKLVDMAKYYGYDGYFINQETTGDLVKPLGEKMRQFMLYSKEYAAKVNHPIKYSWYDAMTYNYGRYHQDGLGEYNYQFMQPEGDKVPADNFFANFNWDKAKNDYTIATANWIGRNPYDVFAGLELQQGGSYKTKVKWNDILDENGKLRLSLGLFAPDTITSLGKTGEDYHKNEDIFFTGYQGDPTGQKPGDKDWYGIANLVADRTPAVGNTFTTSFNTGHGKKWFVDGKVSKDSEWNYRSVSGVLPTWRWWQTSTGEKLRAEYDFTDAYNGGNSLKFSGDVAGKTDQDVRLYSTKLEVTEKTKLRVAHKGGKGSKVYMAFSTTPDYKFDDADAWKELTLSDNWTNEEFDLSSLAGKTIYAVKLFFEHEGAVKDYQFNLGQLTISDNHQEPQSPTSFSVVKQSLKNAQEAEAVVQFKGNKDADFYEVYEKDGDSWKLLTGSSSTTIYLPKVSRSASAQGTTQELKVVAVGKNGVRSEAATTTFDWGMTVKDTSLPKPLAENIVPGATVIDSTFPKTEGGEGIEGMLNGTITSLSDKWSSAQLSGSVDIRLTKPRTVVRWVMDHAGAGGESVNDGLMNTKDFDLYYKDADGEWKLAKEVRGNKAHVTDITLDKPITAQDWRLNVVTSDNGTPWKAIRIYNWKMYEKLDTESVNIPMAKAAARSLGNNKVQVGFADVPAGATITVYDNPNSQTPLATLKSEVGGDLASAPLDLTNQSGLLYYRTQLPGKEISNVLAVSVPKDDRRIKSVSLETGPKKTSYAEGEDLDLRGGVLRVQYEGGTEDELIRLTHAGVSVSGFDTHHKGEQNLTLQYLGQPVNANLSVTVTGQDEASPKTILGIEVSQEPKKDYLVGDSLDLSEGRFAVAYSNDTMEEHSFTDEGVEISGYDAQKTGRQTLTLHYQGHEVSFDVLVSPKAALNDEYLKQKLAEVEAAKNKVVYNFASSEVKEAFLKAIEAAEQVLKDHETSTQDQVNDRLNKLTEAHKALNGQEKFTEEKTELDRLTGEVQELLAAKPNHPSGSALAPLLEKNKALVEKVDLSPEELTTAKQSLKDLVALLKEDKPAVFSDSKTGVEVHFSNKEKTVIKGLKVERVQASAEEKKYFAGEDAHVFEIEGLDEKGQDVDLSYASIVKIPIEKDKKVKKVFFLPEGKEAVELAFEQTDSHVIFTAPHFTHYAFVYESAEKPQPAKPAPQNTVLPKPTYQPTSDQQKAPKLEVQEEKVAFHRQEHENTEMLVGEQRVIIQGRDGLLRHVFEVDENGQRRLRSTEVIQEAIPEIVEIGTKVKTVPAVVATQEKPAQNTAVKSEEASKQLPNTGTADANEALIAGLASLGLASLALTLRRKREDKD

SEQ ID NO: 250 - protein, 320 aa, Streptococcus pneumoniae
MVTIINIGGSYYLQGILDEYIPNQMKSTLGIISVGLVITYILQQVMSFSRDYLLTVLSQRLSIDVILSYIRHIFELPMSFFATRRTGEIISRFTDANSIIDALASTILSLFLDVSILILVGGVLLAQNPNLFLLSLISIPIYMFIIFSFMKPFEKMNHDVMQSNSMVSSAIIEDINGIETIKSLTSEENRYQNIDSEFVDYLEKSFKLSKYSILQTSLKQGTKLVLNILILWFGAQLVMSSKISIGQLITFNTLFSYFTTPMENIINLQTKLQSAKVANNRLNEVYLVESEFQVQENPVHSHFLMGDIEFDDLSYKYGFG

SEQ ID NO: 251 - protein, 77 aa, Streptococcus pneumoniae
MYKHLFFLDSKTLDRLTPYILVLASDTIAFNVFVLTFVSAVVFNFLNSMLALMAIFIGAGYVVGFWLLILNENQRAN

SEQ ID NO: 252 - protein, 203 aa, Streptococcus pneumoniae
MEFFDKFHALCFGFLVLIIVITVPYTINHGGFFQNESALILVSLLVTSLSVAYARKFEMISFGMLSKKQLLLFIAIFLLSVLETLVYIHFFAVSSGSGVQHLAEVSRGISLSLILTTSVFGPIQEELIFRGLLQGAVFDNSWLGLVLTSSLFSFMHGPSNVPSFIFYLLGGLLLGFAYKKSQNLWVSTLVHMLYNSWPLLYYL

SEQ ID NO: 253 - protein, 612 aa, Streptococcus pneumoniae
MSYKDTVQKILDVIGGEKNVNRVTHCVTRLRLELKDENLVNDDDVKKIPGVIGIMKKNGQYQIILGNDVANYYKEFVKLGNFESDSVVQGHKGNILERIIEYIAGSMTPIIPAMLGGGMLKVLVIILPMLGILQSDSQTIAFLTFFGDAPYYFLPLLLAYSASQKLKVTSTLAMSVAGVLLHPNFVQMVQSGNPLSLFGAPVTPASYGSSVVPILIMVWLMKYIEKIIAKLTLAITKSFLQPTLVLLVSSCIALVVVGPIGVIVGEGLSNLVGQMYGVAGWLTLAILGAIMPFIVMTGMHWAFAPIFLAASIATPDVLILPAMLGSNLAQGAASMAVALKSKNNNTKQIAFAAGFSALLAGITEPALYGVTLKYKKPLYAAMIGGGLAGLFAGLTSVKAYLFAVPSLIALPQFIYSDVPSNIVNALIVAVISVVITFVLAYIFGIDEEESSSNLEVEAGVSNKKMIFSPISGEIIPLSDVQDKTFSDKLIGDGVAIIPSEGKVYAPFDGKITNIFPTKHAIGLKSDEGVELLIHIGLDTVELKGQGFISHVEEGDRVFKNQLIFEMDLNLIKTKGYETVTPVIVTNTNDFLDVLVLPNNQTIEHSKELLVIL

SEQ ID NO: 254 - protein, 75 aa, Streptococcus pneumoniae
MVGIAKSFWIKSAKRTVVSLILNLLLLAVTLIKWGANSCISCKAEIMLSLPTAGFGGNTSNESDGVWRDICNNLF

SEQ ID NO: 255 - protein, 219 aa, Streptococcus pneumoniae
MESILEVLTPDNLVFIFKGFGLTLYISLIAIILSTIIGTVLAVTRNGKNPVLRIISSIYIEFVRNVPNLLWIFTIFLVFKMKSTPAGITAFTLFTSAALAEIIRGGLNAVDKGQYEAGMSQGFTSAQILYYIILPQAIRKMLPAIISQFVTVIKDTSLLYSVIALQELFGASQILMGRYFEPEQVFSLYILIALIYFSFNLAISSLSHMLAKRWQQAAE

SEQ ID NO: 256 - protein, 252 aa, Streptococcus pneumoniae
MALVEFKNVEKYYGDYHAFRNINLRFEKGQVVVLLGPSGSGKSTLIRTINGLETVDKGSLLVNGHQVAGASQKDLVPLRKEVGMVFQHFNLYPHKAVLENVTLAPIEVLGIDKKEAEKTAQKYLEFVNMWDKKDSYPAMLSGGQKQRIAIARGLAMHPELLLFDEPTSALDPETIGDVLAVMQKLAHDGMNMIIVTHEMGFAREVADRIIFMADGEVLVDTTDVDNFFDNPSEPRAQQFLSKIINHESDKVK

SEQ ID NO: 257 - protein, 406 aa, Streptococcus pneumoniae
MYRYQIGIPTLEYDQFVKEHELANVLQSSAWEEVKSNWQHEKFGVYREEKLLATASILIRTLPLGYKMFYIPRGPILDYGDKELLNFAIQSIKSYARSKRAVFVTFDPSICLSQSLINQEKTEFPENLAIIDSLQQMGVRWSGKTEEMGDTIQPRIQAKIYKENFEEDKLSKSTKQAIRTARNKGLEIQYGGLELLDSFSELMKKTEKRKEIHLRNEAYYKKLLDNFKDKAYITLATLDVSKRSQELEEQLAKNRALEETFTESTRTSKVEAQKKEKERLLEELTFLQEYIDVGQARVPLAATLSLEFGTTSVNIYAGMDDDFKRYNAPILTWYETARYAFERGMIWQNLGGVENSLNGGLYHFKEKFNPTIEEYLGEFTMPTHPLYPLLRLALDFRKTLRKKHRK

SEQ ID NO: 258 - protein, 194 aa, Streptococcus pneumoniae
MKEIFMAKKGTLTGLLLFGIFFGAGNLIFPPSLGALSGEHFLPAIAGFVFSGVGIAVLTLIIGTLNPKGYIYEISTKIAPWFATLYLSVLYLSIGPFFATPRTATTAYEVGISPLLSDANKGLGLIVFTVLYFAAAYLISLNPSKILDRIGRILTPVFAILIVILVVLGAIKYGGTSPQAASLLIKLLPLVQVS

SEQ ID NO: 259 - protein, 561 aa, Streptococcus pneumoniae
MKGGTPGVYILSQATQEIFGSTAQLFLAAMVTVTCFTTTVGLIVSTAEFFNERFPQISYKVYATAFTLIGFAIANLGLDAIIKYSIPVLVILYPITIAIVMIVIVNKFVALSKPGMQLTIAVVTVIAIASVLGSSLRLSFLQILLAFFLLPRHLSHGWCQPLLESCSHWFYQTSKKAMFLKWNNHLNHFCSQVYRSDFLFLSDDKCVIIGSERGEEMNQTVEYIKELTAIASPTGFTREIADYLVKTLEGFGYQPVRTSKGGVNVTIKGQNDEQHRYVTAHVDTLGAIVRAVKPDGRLKMDRIGGFPWNMIEGENCTIHVASTGEKVSGTILIHQTSCHVYKDAGTAERTQDNMEVRLDAKVTSEKETRALGIEVGDFISFDPRTVVTETGFIKSRHLDDKVSAAILLNLLRIYKEEKIELPVTTHFAFSVFEEVGHGANSNIPAQVVEYLAVDMGAMGDDQQTDEYTVSICVKDASGPYHYDFRQHLVALAKEQDIPFKLDIYPFYGSDASAAMSAGAEVKHALLGAGIESSHSYERTHIDSVIATERMVDAYLKSTLVD

SEQ ID NO: 260 - protein, 330 aa, Streptococcus pneumoniae
MAMIEVEHLQKNFVKTVKEPGLKGALRSFIHPEKQTFEAVKDLTFEVPKGQILGFIGANGAGKSTTIKMLTGILKPTSGFCRINGKIPQDNRQDYVKDIGVVFGQRTQLWWDLALQETYTVLKEIYDVPDSLFHKRMDFLNEVLDLKDFIKDPVRTLSLGQRMRADIAASLLHNPKVLFLDEPTIGLDVSVKDNIRRAITQINQEEETTILLTTHDLSDIEQLCDRIFMIDKGQEIFDGTVSQLKETFGKMKTLSFELLPGQSHLVSHYDGLSDMTIDRQGNSLNIEFDSSRYQSADIIKQTLSDFEIRDLKMVDTDIEDIIRRFYRKEL

SEQ ID NO: 261 - protein, 491 aa, Streptococcus pneumoniae
MDAIFDLIGKVFNPILEMGGPVIMLIILTVLALLFGVKFSKALEGGIKLAIALTGIGAIIGMLNTAFSASLAKFVENTGIQLSITDVGWAPLATITWGSAWTLYFLLIMLIVNIVMLAMKKTDTLDVDIFDIWHLSITGLLIKWYADNNGVSQGVSLFIATAAIVLVGVLKIINSDLMKPTFDDLLNAPSSSPMTSTHMNYMMNPVIMVLDKIFEKFFPGLDKYDFDAAKLNKKIGFWGSKFFIGFILGIVIGIMGTPHPIAGVADADKWRLVIKGWLSLGLTAGVSLELFSLIGSWFIAAVEPLSQGITNVATKRLQGRKFNIGLDWPFIAGRAEIWACANVLAPIMLIEAVLLSKVGNGILPLAGIIAMGVTPALLVVTRGKLLRMIIFGTLLLPLFLLSGTLIAPFATELAKGVGAFPEGVSQTQLITHSTLEGPIEKLLGWTIGNTTTGDIKAILGAVVFLVFYIGIFAWYRKQMIKRNEEYAAKAK

SEQ ID NO: 262 - protein, 106 aa, Streptococcus pneumoniae
MILTLVVCIILTKLFRLKKLGRNFADLAFPVLVFEYYLITAKTFTHNFLPRLGLALSILAIILVFFFLLKKRSFYYPKFIKFFWRAGFLLTLIMYIEMIVELFLMK

SEQ ID NO: 263 - protein, 236 aa, Streptococcus pneumoniae
MGHIFFFLSVFLAGILSFFSPCILPLLPVYTGVLLDDKDGAQASSGKFSISVTSLLRTLAFIAGISFIFILLGYGAGFLGDLLYASWFQYLTGAIIILLGLHQMEILHFKGLYKEKRLQLQGQGQNGKGYSQAFLLGLTFSFAWTPCVGPVLGSVLALAASGGSGAWQGAGLMLVYTLGLALPFLLLALTSSYVLKHFRKLHPYLGILKKVGGFLIIVMGFLVLFGNASILSQLFE

SEQ ID NO: 264 - protein, 91 aa, Streptococcus pneumoniae
MGMTNLSQNRANRNLNMLDMHANCSVSDIQSSMSLDKFNLNWILHKLKGCQLPRTSCMKSRMDTDNFQTKLLCHLTFNNESPIDMLTTLNC

SEQ ID NO: 265 - protein, 332 aa, Streptococcus pneumoniae
MNKRLFSKMSLVTLPILALFSQSVLAEENIHFSSCKEAWANGYSDIHEGEPGYSAKLDRDHDGVACELKNAPKGAFKAKQSTAIQINTSSATTSGWVKQDGAWYYFDGNGNLVKNAWQGSYYLKADGKMAQSEWIYDSSYQAWYYLKSDGSYAKNAWQGAYYLKSNGKMAQGEWVYDSSYQAWYYLKSDGSYARNAWQGNYYLKSDGKMAKGEWVYDATYQAWYYLTSDGSYAYSTWQGNYYLKSDGKMAVNEWVDGGRYYVGADGVWKEVQASTASSSNDSNSEYSAALGKAKSYNSLFHMSKKRMYRQLTSDFDKFSNDAAQYAIDHLDD

SEQ ID NO: 266 - protein, 412 aa, Streptococcus pneumoniae
MIETEKKEERVLLIGVELQGMDSFDLSMEELASLAKTAGAVVVDSYRQKREKYDSKTFVGSGKLEEIALMVDAEEITTVIVNNRLTPRQNVNLEEVLGVKVIDRMQLILDIFAMRARSHEGKLQVHLAQLKYLLPRLVGQGIMLSRQAGGIGSRGPGESQLELNRRSVRNQITDIERQLKVVEKNRATVREKRLESSTFKIGLIGYTNAGKSTIMNILTSKTQYEADELFATLDATTKSIHLGGNLQVTLTDTVGFIQDLPTELVSSFKSTLEESKHVDLLVHVIDASNPYHEEHEKTVLSIMKDLDMEDIPHLTLYNKADLVEDFTPTQTPYTLISAKSEDSRENLQALLLDKIKEIFEAFTLRVPFSKSYKIHDLESVAILEERDYQEDGEVITGYISEKNKWRLEEFYD

SEQ ID NO: 267 - protein, 84 aa, Streptococcus pneumoniae
MVYLVLGILLLLLYVFATPESIKGTVNIVAMVCILVALLILLVLSFLKIFQLPTEIFLAIAMLILAYFSVRDITLMPVKKSKRR

SEQ ID NO: 268 - protein, 211 aa, Streptococcus pneumoniae
MYGVRKLIVADYDIIEPSNLNRQILYTESDVGKEKINVLSEKIHKYNSDVQVVPISIKVSSVEELEKIVAEYGSIDFIVKAIDTPIDIIKIVNQFAVSHKISYISGGFNGCYLIIDNIYIPTIGSCFGCRNINKDINKYTLSDKTKWPTTPEMPAILGGIMTNLIIKIFLGCYNEILIDNAYVYNMRNHALSQEKYVLENGECPICKKIIK

SEQ ID NO: 269 - protein, 126 aa, Streptococcus pneumoniae
MKDNNIRAKTFIRSVCFCLLSGGVAFLSAIGQFTVIETQLIVLFLGIIFAIYYAYYNKNIQTSLENIVWLFSSFEILFLLVNFRTFIQLPVDIFIGMIIFLMLWIFIMLGIVCLSYYITLLFSKEA

SEQ ID NO: 270 - protein, 217 aa, Streptococcus pneumoniae
MGQKSQNLTSGELKRIGLVSDTSGFYEKMSLYNNLLFYSKFYNISKSRVDNLLKRVGLYDSRKMVAGKLSTGMRQRMLLARALINNPAVLFLDEPTSGLDPTTSRTIHELILELKTAGTTIFLTTHDMNEATLLCDYVALLNKGKLVEQGAPSELIQRYNKDKKIKVTDYNGNQITFDFTSLEQVSQTDLENIFSIHSCEPTLEDIFITLTGGKLNA

SEQ ID NO: 271 - protein, 254 aa, Streptococcus pneumoniae
MEFFICNLVRVVQSPRFYMSLFLTLLCMSLGNFLAFNGIYKIEGLSIFFAASSIRGFSPISLVAALICTLPYSSQIIEDAESHFLTAQLCRISKKKYLAIVGSTVIISSFLVFFLPYLLLLGINLLVTPYQEIYIGDYSGALKELFDSNQFLYSLVTTLWYGVWGAVFSIFGLASALLVKKKIGAIFIPVAYMMVGGIFWAILGLSYLEPVTTLALGYQKDISLSLVSAHLAFILFVSCLVVYGTFFLHSEDYV

SEQ ID NO: 272 - protein, 215 aa, Streptococcus pneumoniae
MNEIITLKNIELKLKKTCVFQNLNFSCKQGEIIGITGANGSGKSVLFKLIAGLYSPSYGEVLINGENIVPERKIPANLGALIEEPGFINYYSGFKNLQYLASIRGVVGNQEINDTLKIVGLYEQKDQKVKTYSLGMRKKLGIAQAIMENPSILLLDEPMNALDKSSVENMRTLFRKLSSEKGTTILIASHSEEDIRILCDKVYAIEDKVCTLCSD

SEQ ID NO: 273 - protein, 252 aa, Streptococcus pneumoniae
MSETILEIKELKKSFGDNPILQGLSLEIKKGEVVVILGPSGCGKSTLLRCLNGLESIQGGDILLDGQSIVENKKDFHLVRQKIGMVFQSYELFPHLDVLQNLILGPIKAQGRDKKEVTEEALQLLERVGLLDKQHSFARQLSGGQKQRVAIVRALLMHPEIILFDEVTASLDPEMVREVLELINDLAQEGRTMILVTHEMQFAQAITDRIIFLDQGKIAEEGTAQAFFTNPQTKRAQEFLNVFDFSQFGSYL

SEQ ID NO: 274 - protein, 206 aa, Streptococcus pneumoniae
MHIAVWGILGSFLLGLIVSIIRHYRILVLAQVATAYIELSRNTPLLIQLFFLYFGLPRIGIVLSSEVCATLGLVFLGGSYMAESFRSGLEAISQTQQEIGLAIGLTPLQVFYYVVLPQATAVALPSFSANVIFLIKETSVFSAVALADLMYVAKDLIGLYYETDIALAMLVVAYLIMLLPISLVFSWIERRLRHAGFGNPSTLSRK

SEQ ID NO: 275 - protein, 461 aa, Streptococcus pneumoniae
MGLELRAIQSPIFSEPFDFTFHAQAFTLLVGSSGSGKSSLFQMIAQVSSLPYSGQVLIDGSEVSQLSIVERVQTVGILLQNPNHQFTMESLFEELVFTMENIGYHLQEIDSKIAEVVQQCRCKDILHRLIHHLSGGEKQKAALAVLFAMNPRVYLLDEPFASIDRKSRIEILEILKELVYDGKTVILCDHDLSDYKAYIDHMVELRDGKLREVFQIPSYEMTQVASKEVASSPELFHMNRVTGELGNRPLFSIADFTFYQGISCILGDNGVGKSTLFRSILQFQKYKGSITWKGSVLKKKKSLYRDLTGVVQEAEKQFIRVSLREELQLDGPDSERNQRIFQALRYFDLEQAVDKSPYQLSGGQQKILQLLTILTSKASVILLDEPFAGLDDRACHYFCKWIVEERNQGRSFLLISHRLDPLISVVDYWIEMTSQGLRHVKEVTITKPLTSQSSNTQGEVR

SEQ ID NO: 276 - protein, 397 aa, Streptococcus pneumoniae
MWYNRAMKHFDTIVIGGGPAGMMATISSSFYGQKTLLIEKNRKLGKKLAGTGGGRCNVTNNGSLDNLLAGIPGNGRFLYSVFSQFDNHDIINFFTENGVKLKVEDHGRVFPASDKSRTIIEALEKKITELGGQVATQIEIVSVKKVDDQFVLKSADQTFTCEKLIVTTGGKSYPSTGSTGFGHEIARHFKHTITDLEAAESPLLTDFPHKALQGISLDDVTLSYGKHVITHDLLFTHFGLSGPAALRMSSFVKGGEVLSLDVLPQLSEKDLVTFLEENREKSLKNALKTLLPERLAEFFVQGYPEKVKQLTEKEREQLVQSIKELKIPVTGKMSLAKSFVTKGGVSLKEINPKTLESKLVPGLHFAGEVMDINAHTGGFNITSALCTGWVAGSLHYD

SEQ ID NO: 277 - protein, 83 aa, Streptococcus pneumoniae
MKKKFALSFVALASVALLAACGEVKSGAVNTAGNSVEEKTIKIGFNFEESGSLAAYGTAEQKGAQLAVDEINAAVVSMENKSK

SEQ ID NO: 278 - protein, 254 aa, Streptococcus pneumoniae
MALLEVKQLTKHFGGLTAVGDVTLELNEGELVGLIGPNGAGKTTLFNLLTGVYEPSEGTVTLDGHLLNGKSPYKIASLGLGRTFQNIRLFKDLTVLDNVLIAFGNHHKQHVFTSFLRLPAFYKSEKELKAKALELLKIFDLDGDAETLAKNLSYGQQRRLEIVRALATEPKILFLDEPAAGMNPQETAELTELIRRIKDEFKITIMLIEHDMNLVMEVTERIYVLEYGRLIAQGTPDEIKTNKRVIEAYLGGEA

SEQ ID NO: 279 - protein, 230 aa, Streptococcus pneumoniae
MSIIEMRDVVKKYDNGTTALRGVSVSVQPGEFAYIVGPSGAGKSTFIRSLYREVKIDKGSLSVAGFNLVKIKKKDVPLLRRSVGVVFQDYKLLPKKTVYENIAYAMEVIGENRRNIKRRVMEVLDLVGLKHKVRSFPNELSGGEQQRIAIARAIVNNPKVLIADEPTGNLDPDNSWEIMNLLERINLQGTTILMATHNSQIVNTLRHRVIAIENGRVVRDESKGEYGYDD

SEQ ID NO: 280 - protein, 726 aa, Streptococcus pneumoniae
MMKDTFKNVLSFEFWQKFGKALMVVIAVMPAAGLMISIGKSIVMINPTFAPLVITGGILEQIGWGVIGNLHILFALAIGGSWAKERAGGAFAAGLAFILINRITGTIFGVSGDMLKNPDAMVTTFFGGSIKVADYFISVLEAPALNMGVFVGIISGFVGATAYNKYYNFRKLPDALSFFNGKRFVPFVVILRSAIAAILLAAFWPVVQTGINNFGIWIANSQETAPILAPFLYGTLERLLLPFGLHHMLTIPMNYTALGGTYDILTGAAKGTQVFGQDPLWLAWVTDLVNLKGTDASQYQHLLDTVHPARFKVGQMIGSFGILMGVIVAIYRNVDADKKHKYKGMMIATALATFLTGVTEPIEYMFMFIATPMYLVYSLVQGAAFAMADVVNLRMHSFGSIEFLTRTPIAISAGIGMDIVNFVWVTVLFAVIMYFIANFMIQKFNYATPGRNGNYETAEGSEETSSEVKVAAGSQAVNIINLLGGRVNIVDVDACMTRLRVTVKDADKVGNAEQWKAEGAMGLVMKGQGVQAIYGPKADILKSDIQDILDSGEIIPETLPSQMTEAQQNTVHFKDLTEEVYSVADGQVVALEQVKDPVFAQKMMGDGFAVEPANGNIVSPVSGTVSSIFPTKHAFGIVTEAGLEVLVHIGLDTVSLEGKPFTVHVAEGQKVAAGDLLVTADLDAIRAAGRETSTVVVFTNGDAIKSVKLEKTGSLAAKTAVAKVEL

SEQ ID NO: 281 - protein, 513 aa, Streptococcus pneumoniae
MSILEVKNLSHGFGDRAIFEDVSFRLLKGEHIGLVGANGEGKSTFMSIVTGKMLPDEGKVEWSKYVTAGYLDQHSVLAERQSVRDVLRTAFDELFKAEARINDLYMKMAEDGADVDALMEEVGELQDRLESRDFYTLDAKIDEVARALGVMDFGMDTDVTSLSGGQRTKVLLAKLLLEKPDILLLDEPTNYLDAEHIDWLKRYLQNYENAFVLISHDIPFLNDVINIVYHVENQQLTRYSGDYYQFQEVYAMKKSQLEAAYERQQKEIADLKDFVARNKARVATRNMAMSRQKKLDKMDIIELQSEKPKPSFDFKPARTPGRFIFQAKNLQIGYDRPLTKPLNLTFERNQKVAIIGANGIGKTTLLKSLLGIISPIAGEVERGDYLELGYFEQEVEGGNRQTPLEAVWNAFPALNQAEVRAALARCGLTTKHIESQIQVLSGGEQAKVRFCLLMNRENNVLVLDEPTNHLDVDAKDELKRALKEYRGSILMVCHEPDFYEGWIDQIWDFNNLT

SEQ ID NO: 282 - protein, 267 aa, Streptococcus pneumoniae
MKKLATLLLLSTVALAGCSSVQRSLRGDDYVDSSLAAEESSKVAAQSAKELNDALTNENANFPQLSKEVAEDEAEVIFHTSQGDIRIKLFPKLAPLAVENFLTHAKEGYYNGITFHRVIDGFMVQTGDPKGDGTGGQSIWHDKDKTKDKGTGFKNEITPYLYNIRGALAMANTGQPNTNGSQFFINQNSTDTSSKLPTSKYPQKIIEAYKEGGNPSLDGKHPVFGQVIDGMDVVDKIAKAEKDEKDKPTTAITIDSIEVVKDYDFKS

SEQ ID NO: 283 - protein, 448 aa, Streptococcus pneumoniae
MREYDIIAIGGGSGGIATMNRAGEHGAKAAVIEEKKLGGTCVNVGCVPKKIMWYGAQIAETFHQFGEDYGFKTTDLNFDFATLRRNREAYIDRARSSYDGSFKRNGVDLIEGHAEFVDSHTVSVNGELIRAKHIVIATGAHPSIPNIPGAELGGSSDDVFAWEELPESIAILGAGYIAVELAGVLHTFGVKTDLFVRRDRPLRGFDSYIVEGLVKEMERTNLPLHTHKVPVKLEKTTDGITIHFEDGTSHTASQVIWATGRRPNVKGLQLEKAGVTLNERGFIQVDEYQNTVVEGIYALGDVTGEKELTPVAIKAGRTLSERLFNGKTTAKMDYSTIPTVVFSHPAIGTVGLTEEQAIKEYGQDQIKVYKSSFASMYSACTCNRQESRFKLITAGSEEKVVGLHGIGYGVDEMIQGFAVAIKMGATKADFDATVAIHPTASEEFVTMR

SEQ ID NO: 284 - protein, 444 aa, Streptococcus pneumoniae
MFSKLKKTWYADDFSYFIRNFGVFTLIFSTMTLIILQVMHSSLYTSVDDKLHGLSENPQAVIQLAINRATEEIKDLENARADASKVEIKPNVSSNTEVILFDKDFTQLLSGNRFLGLDKIKLEKKELGHIYQIQVFNSYGQEEIYRVILMETNISSVSTNIKYAAVLINTSQLEQASQKHEQLIVVVMASFWILSLLASLYLARVSVRPLLESMQKQQSFVENASHELRTPLAVLQNRLETLFRKPEATIMDVSESIASSLEEVRNMRFLTTSLLNLARRDDGIKPELAEVPTSFFNTTFTNYEMIASENNRVFRFENRIHRTIVTDQLLLKQLMTILFDNAVKYTEEDGEIDFLISATDRNLYLLVSDNGIGISTEDKKKIFDRFYRVDKARTRQKGGFGLGLSLAKQIVDALKGTVTVKDNKPKGTIFEVKIAIQTPSKKKK

SEQ ID NO: 285 - protein, 356 aa, Streptococcus pneumoniae
MILSLTVHTYFIIFSAENYYRKVTKRIKSLFIFKAWLILEKCGIIFLMEKIVITATAESIEQVEQLLEAGVDRIYVGEKDFGLRLPTTFSYDQLREIAKLVHDAGKELIVAVNALMHQDMMDRIKPFLNFLEEIKTDYITIGDAGVFYVVNRDGYSFKTIYDASTMVTSSRQINFWGQKAGASEAVLAREIPSAELFKMPEILEIPAEVLVYGASVIHHSKRPLLQNYYNFTHIDDEKTHKRDLFLAEPSDPESHYSIFEDNHGTHIFANNDLDLMIKLTELVEHGFTRWKLEGLYTPGQNFVEIAKLFIQARSLIQEGNFSHAQAFLLDEEVRKLHPKNRFLDTGFYDYDPDMVR

SEQ ID NO: 286 - protein, 229 aa, Streptococcus pneumoniae
MTMNFSFLPKYLPYFNYGAVVTILISICVIFLGTILGVVLAFGQRSKFKPLVWLANLYVWIFRGTPMMVQIMIAFALMHINAPTIQIGILGVDFSRLIPGILIISMNSGAYVSETVRAGINAVPKGQLEAAYSLGIRPKNAMRYVILPQAVKNILPALGNEFITIIKDSSLLSAIGVMELWNGATTVSTTTYLPLTPLLFAAFYYLIMTSILTVALKAFEKHMGQGDKK

SEQ ID NO: 287 - protein, 244 aa, Streptococcus pneumoniae
MTETLIKIENLHKSFGKNEVLKGINLEIKRGEVVVIIGPSGSGKSTLLRSMNLLEEATKGKVIFEGVDITDKKNDLFAMREKMGMVFQQFNLFPNMTVMENITLSPIKTKGDSKAVAEKRAQELLEKVGLPDKADAYPQSLSGGQQQRIAIARGLAMEPDVLLFDEPTSALDPEMVGEVLAVMQDLAKSGMTMVIVTHEMGFAREVADRVIFMADGVVVEDGTPEQIFEQTQGQRTKDFLSKVL

SEQ ID NO: 288 - protein, 78 aa, Streptococcus pneumoniae
MKILKRYILELCFILSFALPFIKGTNADNGRCFVETYYGFTFLMEHAIVTAVFICSFLIAFLLKNDGRNGLLRVVIAF

SEQ ID NO: 289 - protein, 511 aa, Streptococcus pneumoniae
MAHENVIEMRDITKVFGGFVANDKINLHLRKGEIHALLGENGAGKSTLMNMLAGLLEPTSGEIAVNGQVVNLDSPSKAASLGIGMVHQHFMLVEAFTVAENIILGSELTKNGVLDIAGASKEIKALSERYGLAVDPSAKVADISVGAQQRVEILKTLYRGADILIFDEPTAVLTPSEIDELMAIMKNLVKEGKSIILITHKLDEIRAVSDRVTVIRRGKSIETVEIAGATNADLAEMMVGRSVSFKTEKQASKPKEVVLSIKDLVVNENRGVPAVKNLSLDVRAGEIVGIAGIDGNGQSELIQAITGLRKVESGSIELKGDSIVGLHPRQITELSVGHVPEDRHRDGLILEMMISENIALQTYYKEPHSKNGILNYSNITSYAKKLMEEFDVRAASELVPAAALSGGNQQKAIIAREIDRDPDLLIVSQPTRGLDVGAIEYIHKRLIEERDNGKAVLVVSFELDEILNVSDRIAVIHDGKIQGIVSPETTNKQELGVLMAGGNLGKEKSDV

SEQ ID NO: 290 - protein, 307 aa, Streptococcus pneumoniae
MTELAKQLLELTYIVIGCQFLHTAYCSYKDKTNPVRLGTSAFWTLLSITFIGGSYMPNMSIGIIVILLSLLTLFKQVRIGTLPSLDEMKANIESNRLKNKIFIPVMLMAILALVLAQMIPEFSKISISLAALFATISVLVITNSHPKSLLSENNRMTQQVSTSGIVPQLLGALGAIFTVAGVGDVISHLISGIVPSDSRFIGVLAYVLGMVLFTMIMGNAFAAFTVITAGVGVPFVFALGANPIVAGALAMTAGYCGTLLTPMAANFNALPAALMDMKDQNGVIKAQAGVALVMIVIHIFLMYFLAF

SEQ ID NO: 291 - protein, 369 aa, Streptococcus pneumoniae
MFRRNKLFFWTTEILLLTIIFYLWRQMGSLINPFVSVLNTIMIPFLLGGFFYYLTNPIVTFLNKVCKLNRLLGILITLCTLVWGMVIGVVYLLPILINQLSSLIISSQTIYSRVQDLIIDLSNYPALQNLDVEATIQQLNLSYVDILQNILNSVSNSVGSVLSALISTVLILIMTPVFLVYFLLDGHKFLPMLERTILKRDRLHIAGLLKNLNATIARYISGVSIDAIIIGCLAYIGYSIIGLKYALVFAIFSGVANLIPYVGPSIGLIPMIIANIFTDPHRLLIAVIYMLVVQQVDGNILYPRIVGSVMKVHPITILVLLLLSSNIYGVVGMIVAVPTYSILKEISKFLSHLYENHKIMKERERELAK

SEQ ID NO: 292 - protein, 662 aa, Streptococcus pneumoniae
MFRLTNKLAVSNLIKNRKLYYPFALAVLLAVTITYLFYSLTFNPKIAEIRGGTTIQATLGFGMFVVTLASAIIVLYANSFVMKNRSKELGIYGMLGLEKRHLISMTFKELVVFGILTVGAGIGIGALFDKLIFAFLLKLMKLKVELVATFQMNVVIAVLVVFGLIFLGLMFLNALRIARMNALQLSREKASGEKRGRFLPLQTILGSISLGIGYYLALTVTDPLTALTTFFLAVLLVIFGTYLLFNAGITVFLQILKKNKKYYYQPNNLISVSNLIFRMKKNAVGLATIAILSTMVLVTMSAATSIFNSAESFKKVLNPHDFGVSGQNVEKEDLDKLLSQFASDKGYSVKEKEVLRYSNFGIANQEGTKLTIFEKGQNRVQPTTVFMVFDQKDYENMTGQKLSLSGNEVGLFAKNDGLKGQKALTLNDHQFSVKEEFNKDFIVNHVPNKFNILTTDYNYLVVPDLQAFLDQFPDSAIYNQFYGGMNVNVSEEEQLKVAEEYENYLNQFNAQLDTEGSYVYGSNLADASSQMSALFGGVFFIGIFLSIIFMVGTVLVIYYKQISEGYEDRERFIILQKVGLDQKQIKQTINKQVLTVFFLPLLFAFIHLAFAYHMLSLILKVIGVLDTTMMLIVTLSICAIFLIAYVLIFMITSRSYRKIVQM

SEQ ID NO: 293 - protein, 419 aa, Streptococcus pneumoniae
MSRLLVIGCGGVAQVAISKICQDSETFTEIMIASRTKSKCDDLKAKLEGKTSTKIETAALDADKVEEVIALIESYKPEAVLNVALPYQDLTIMDACLATGVHYIDTANYEAEDTEDPEWRAIYEKRCKELGFTAYFDYSWQWAYQEKFKEAGLTALLGSGFDPGVTSVFSAYALKHYFDEIHYIDILDCNGGDHGYPFATNFNPEINLREVSAPGSYWEDGKWVEVEAMSIKREYDFPQVGQKDMYLLHHEEIESLAKNIPGVKRIRFFMTFGQSYLTHMKCLENVGLLRTDTINFNGQEIVPIQFLKALLPDPASLGPRTVGKTNIGCIFTGVKDGVKKTIYIYNVCDHQECYAEVGSQAISYTTGVPAMIGTKLVMNGTWKQAGVYNLEELDPDPFMEALNEYGLPWVVVENPQMVD

SEQ ID NO: 294 - protein, 216 aa, Streptococcus pneumoniae
MEAIIEKIKEYKIIVICTGLGLLVGGFFLLKPAPQTPVKETNLQAEVAAVSKDSSTEKEVKKEEKEEPLEQDLITVDVKGAVKSPGIYDLPVGSRVNDAVQKAGGLTEQADSKSLNLAQKVSDEALVYVPTKGEEAVSQQTGSGTASSTSKEKKVNLNKASLEELKQVKGLGGKRAQDIIDHREANGKFKSVDELKKVSGIGGKTIEKLKDYVTVD

SEQ ID NO: 295 - protein, 502 aa, Streptococcus pneumoniae
MLQWIKNFSIPLIYLSFLLLWLYYAIFSASYLALLGFVFLLVCLFIQFPWKSAGKVLIICGIFGFWFVFQNWQQSQASQNLADSVERVRILPDTIKVNGDSLSFRGKSNGRAFQVYYKLQSEEEKEAFQALTDLHEIGLEGKLSEPEGQRNFGGFNYQAYLKTQGIYQTLNIKTIQSLQKIGSWDIGENLSSLRRKAVVWIKTHFPDPMGNYMTGLLLGHLDTDFEEMNELYSSLGIIHLFALSGMQVGFFMNGFKKLLLRLGLTQEKLKWLTYPFSLIYAGLTGFSASVIRSLLQKLLAQHGVKGLDNFALTVLVLFIVMPNFFLTAGGVLSCAYAFILTMTSKEGEGLKAVTSESLVISLGILPILSFYFAEFQPWSILLTFVFSFLFDLVFLPLLSILFVLSFLYPVIQLNFIFEWLEGIIRLVSQVARRPLVFGQPNAWLLILLLISLALVYDLRKNIKGLTVLSLLITGLFFLTKYPLENEITMLDVGQGESIFYGM

SEQ ID NO: 296 - protein, 77 aa, Streptococcus pneumoniae
MYNLLLTILLVLSVVIVIAIFMQPTKNQSSNVFDASSGDLFERSKARGFEAVMQRLTGILVFFWLAIALALTVLSSR

SEQ ID NO: 297 - protein, 280 aa, Streptococcus pneumoniae
MLSWLARVIKGIVIALGFILPGISGGVLAAILGIYERMIGFLAHPFKDFKENVLYFIPVAIGMLLGIGLFSYPIEYLLENYQVFVLWSFAGAIIGTVPSLLKESTRESDRDKIDLAWLWTTFIISGLGLYALNFVVGTLSASFLNFVLAGALLALGVLVPGLSPSNLLLILGLYAPMLTGFKTFDFLGTFFPIGIGAGATLIVFSKLIDYALNNYHSRVYHFIIGIVLSSTLLILIPNAGNAESIQYTGLSLVGYVIIAFFFALGIWLGIWMSQLEDKYK

SEQ ID NO: 298 - protein, 210 aa, Streptococcus pneumoniae
MFYLSLSRIALSSSTSLVSVSAEPFSSFTKSRVSWRRFWALARTFLSAFSASSCPRTLINSVLNCWISDSFLRRISQKAITPRRASRLTTITPAGTEFVSVILSESLLSSVPCFASFLSCAGLLSLAFAFTSLRESKAAQPSQTLLQYADLTLSRHYLPELFEHLGGQPWLHRFSDQILLPKLSSVGLTLDSRHEVQTCQLALELVCSLS

SEQ ID NO: 299 - protein, 235 aa, Streptococcus pneumoniae
METIVFLISVFLAGVLSFFSPCIFPLLPVYAGILLDDQESAKSFSLFGRKVLWSGLIRTLCFIAGISLIFFILGFGAGYFGHILYANWFRYGMGAIIIILGLHQMEIFHLKKLEVQKSFTFKKSDSNRYWSAFLLGITFSFGWTPCIGPVLSSVLALAASGGNGAWQGAIYTLIYTLGMALPFLVLALASGLVMPYFSKIKRHMMLLKKIGGFLIVLMGILLLLGQVNVLAGIFE

SEQ ID NO: 300 - protein, 311 aa, Streptococcus pneumoniae
MVKELFMKKQNLFLVLLSVFLLCLGACGQKESQTGKGMKIVTSFYPIYAMVKEVSGDLNDVRMIQSSSGIHSFEPSANDIAAIYDADVFVYHSHTLESWAGSLDPNLKKSKVKVLEASEGMTLERVPGLEDVEAGDGVDEKTLYDPHTWLDPEKAGEEAQIIADKLSEVDSEHKETYQKNAQAFIKKAQELTKKFQPKFEKATQKTFVTQHTAFSYLAKRFGLNQLGIAGISPEQEPSPRQLTEIQEFVKTYKVKTIFTESNASSKVAETLVKSTGVGLKTLNPLESDPQNDKTYLENLEENMSILAEELK

SEQ ID NO: 301 - protein, 125 aa, Streptococcus pneumoniae
MLKNLKSFLLRGNVIDLAVGVVIASAFGAIVTSLVNDIITPLILNPALKAAKVERIAQLSWHGVGYGNFLSAIINFIFVGTALFFIIKGIEKAQKLTGIKEEKTDEKKPTELEVLQEIKALLEKK

SEQ ID NO: 302 - protein, 339 aa, Streptococcus pneumoniae
MHAKMRNKKQINLGIIFIICLGLLITIFLSLKLGTKEINIRDFLAAFGMGNTNDDFIKSIIYKRIPRTIFAILAGSSLAISGVLMQSVTRNPIADPGILGINTGASLSVVIGLSFLGISSSISHISFAIIGGLVSAIFVYAIAVSGKAGLTPIKLALSGTCVSMALSSFVSFLILPNNNVLDKFRFWQIGSLGAATLSSISTLLPFIILGHLIAIFISSDLNALAMGDEMAVGLGVNVNRIRSLAIIASVLLCSSITAIGGPIGFVGLIVPHFCGLFISKDIRTMTISSSFIGAELLLICDIIGRMLGKPGEIEVGIITAIIGGPVLIYVTMKNRGVNN

SEQ ID NO: 303 - protein, 335 aa, Streptococcus pneumoniae
MQNLIIGIQKRKNRITLFSSLFLLIIISLSFFILLIGDESYSFSTLIKVLNSETVPGASFSIMEIRLPKLLAGIIAGWSFGLAGFIFQTMLRNPLASPDIIGVTSSSSIAAVFCILVLKTNSLTTGIISITCGLTSSLILFLLAKKDGFSAARLIILGIGFQAVTRAGTSFLLLKVARYELQEVMRWLSGSLSFTKLDDIPLVLIVSIIATILVLFFNKRLEIIELGEEIAIGLGANPELSRLVLIFCAVSLTAFSTSITGPIACISFLAGPIALNIGKKRSPILAGLVGILLVLLSDIFSQNILPARYPVGVVTGLLGSPYLIYLLIKMNRRNI

SEQ ID NO: 304 - protein, 305 aa, Streptococcus pneumoniae
MNCFLKMNNVSVRYDDVIALKDITLQINKGDFIGLLGSNGAGKSTLINSIVGFQEIYLGEIEYCDKDLIVSSQPFAHLGFTPQTTVIDFYTTVKDNVILGLNLAGKFGKNAEKLCQIALEIVGLADKKNNLVETLSGGQLQRVQIARAIAHNPDFYILDEPTVGLDTESAEKFLMYLKDKSLEGKTIIISSHDINLLEKFCKKILFLQNGSISFFGDMRDFVDNSTIKLNFSMQNRISRYQIEFLENFRFKVHIEDNDSFTIEVPIEEKILDVINEVGKACEIKNFSTSKLTLQESYLQRIGGEK

SEQ ID NO: 305 - protein, 266 aa, Streptococcus pneumoniae
MKADQLRHKSDLGLRGLAIIAKNEIIAFFRSKGLIISQFLQPILYVVFIIIGLNSSIKNIQFNDIKTSYAEYTIIGVIALLIIGQMTQVIYRVTIDKKYGLLALKLCSGVRPLYYILGMSIYSILGLIVQEIIIYIITLAFEINIAMDRFFYTVLLSIVVLLFWDSLAILLTMFINDYRRRDIVIRFVLTPLGFTAPVFYLIDSAPSIVRWIGQLNPLTYQLTILRNFYFKNSTTLELVFLLLTSLLVLISVSFIIPKIKLILIER

SEQ ID NO: 306 - protein, 344 aa, Streptococcus pneumoniae
MLKEIKRRNRMKNKRLIGIIAALAVLVAGSLIYSSMNKSEAQNNKDEKKITKIGVLQFVSHPSLDLIYKGIQDGLAEEGYKDDQVKIDFMNSEGDQSKVATMSKQLVANGNDLVVGIATPAAQGLASATKDLPVIMAAITDPIGANLVKDLKKPGGNVTGVSDHNPAQQQVELIKALTPNVKTIGALYSSSEDNSKTQVEEFKAYAEKAGLTVETFAVPSTNEIASTVTVMTSKVDAIWVPIDNTIASGFPTVVSSNQSSKKPIYPSATAMVEVGGLASVVIDQHDLGVATGKMIVQVLKGAKPADTPVNVFSTGKSVINKKIAQELGITIPESVLKEAGQVIE

SEQ ID NO: 307 - protein, 252 aa, Streptococcus pneumoniae
MTAIVELKNATKIVKNGFDEEKIILNDVSLEIFERDFITILGGNGAGKSTLFNTIAGTLSLTSGTIRILGEDLTKFSPEKRAKYLSRVFQDPKMGTAPRMTVAENLLIAKFRGEKRGLLPRRLTSYKDEFQATIEKVGNGLEKHLNTPIEFLSGGQRQALSLLMATLKRPELLLLDEHTAALDPKTSVALMELTDEFVKKDQLTALMITHHMEDALKYGNRLIVMKEGRIIQDLNQEEKAKMKISDYYQLFE

SEQ ID NO: 308 - protein, 234 aa, Streptococcus pneumoniae
MGGKMRLLPIRKISRQSKRLALFLTFCAGYVDAYTFIVRGNTLVAGQTGNVVFLSVELIKNNVSDVRDKVLTLLAFMMGVFLLTIYKEKLRIVKKPILSLIPLAILSIIIAFVPQTVDNIYLVPPLAFCMGLVTTAFGEVSGIAYNNAFMTGNIKRTMLAFGDYFRTKHTPFLREGFIFVSLLSSFVLGVVFSAYLTIFYHEKTILGVPIMMSVFYLSMLFASWQKKVKEKASF

SEQ ID NO: 309 - protein, 282 aa, Streptococcus pneumoniae
MIKKIYPIFTILLGAAIYAFGLTYFVVPHHLFEGGATGITLITFYLFKIPVSLMNLLINIPLFILAWKIFGAKSLYSSLLGTLALSGWLAFFEHIPLHIDLQGDLLITALIAGILLGIGLGIIFNAGGTTGGTDILARILNKYTHISIGKLLFILDFCILMLILLIFKDLRLVSYTLLFDFIVSRVIDLIGEGGYAGKGFMIITKRPDQLAKAINDDLGRGVTFISGQGYYSKENLKIIYCIVGRNEIVKTKEMIHRIDPQAFITITEAHEILGEGFTFEKE

SEQ ID NO: 310 - protein, 91 aa, Streptococcus pneumoniae
MANKQDLIAKVAEATELTKKDSAAAVEAVFAAVADYLAAGEKVQLIGFGNFEVRERAERKGRNPQTGKEMTIAASKVPAFKAGKALKDAVK

SEQ ID NO: 311 - protein, 356 aa, Streptococcus pneumoniae
MKREILLERIDKLKQLMPWYVLEYYQSKLAVPYSFTTLYEYLKEYDRFFSWVLESGISNADKISDIPLSVLENMSKKDMESFILYLRERPLLNANTTKQGVSQTTINRTLSALSSLYKYLTEEVENDQGEPYFYRNVMKKVSTKKKKETLAARAENIKQKLFLGDETEGFLTYIDQEHPQQLSNRALSSFNKNKERDLAIIALLLASGVRLSEAVNLDLRDLNLKMMVIDVTRKGCKRDSVNVAAFAKPYLENYLAIRNQRYKTEKTDTALFLTLYRGVPNRIDASSVEKMVAKYSEDFKVRVTPHKLRHTLATRLYDATKSQVLVSHQLGHASTQVTDLYTHIVSDEQKNALDSL

SEQ ID NO: 312 - protein, 118 aa, Streptococcus pneumoniae
MAPRFPASRSAICIDPPFPLQVPVYLPRISAIIPLRSIPLAIACPCPRWFEVIRSSGLRANIAPTLAASSPTEKCVIPGTFPFFTNCAIFKSMRRISSILRNISSKRFLSKVDIFLPF

SEQ ID NO: 313 - protein, 563 aa, Streptococcus pneumoniae
MNKLIAFIEKGKPFFEKLSRNIYLRAIRDGFIAGMPVILFSSIFILIAFVPNSWGFKWSDEVVAFLMKPYSYSMGILALLVAGTTAKSLTDSVNRSMEKTNQIKYMSTLLAAIVGLLMLAADPIESGLATGFLGTKGLLSAFLAAFVTVAIYKVCVKNNVTIRMPDEVPPNISQVFKDVIPFTLSVVSLYALDLLARYFVGSSVAESIGKFFAPLFSAADGYLGITIIFGAFAFFWFVGIHGPSIVEPAIAAITYANAEVNLNLLQQGMHADKILTSGTQMFIVTMGGTGATLVVPFMFMWLTKSKRNRAIGRASVVPTFFGVNEPILFGAPLVLNPIFFIPFIFAPIANVWIFKFFIETLGMNSFTANLPWTTPAPLGLVLGTNFQVLSFILAALLIVVDVVIYYPFLKVYDEQILEEERSGKSNDELKEKVAANFNTAKADAILEKAGVDAAQNTITEETNVLVLCAGGGTSGLLANALNKAAAEYNVPVKAAAGGYGAHREMLPEFDLVILAPQVASNFEDMKAETDKLGIKLAKTEGAQYIKLTRDGKGALAFVQAQFD

SEQ ID NO: 314 - protein, 265 aa, Streptococcus pneumoniae
MVSSEFISKIEFACNKKESLYSQSKFKYAIRSMFAGAFLTFSTAAGAVGADLINKIAPGSGRFLFPFVFAWGLAYIVFLNAELVTSNMMFLTAGSFLKKISWRKTAEILLYCTLFNLIGALIAGWGFAHSAAYANLTHDSFISGVVEMKLGRSNELVLLEAILANIFVNIAILSFILVKDGGAKLWLVLSAIYMFVFLTNEHIAANFASFAIVKFSVAADSIANFGVGNMLRHWGVTFIGNFIGGGLLMGLPYAFLNKNEDTYVD

SEQ ID NO: 315 - protein, 449 aa, Streptococcus pneumoniae
MLDLLKQTIFTRDFIFILILLGFILVVTLLLLENRRDNIQLKQVNQKVKDLIAGDYSKVLDMQGGSEITNITNNLNDLSEVIRLTQENLEQESKRLNSILFYMTDGVLATNRRGQIIMINDTAKKQLGLVKEDVLNRSILELLKIEENYELRDLITQSPELLLDSQDINGEYLNLRVRFALIRRESGFISGLVAVLHDTTEQEKEERERRLFVSNVSHELRTPLTSVKSYLEALDEGALCETVAPDFIKVSLDETNRMMRMVTDLLHLSRIDNATSHLDVELINFTAFITFILNRFDKMKGQEKEKKYELVRDYPINSIWMEIDTDKMTQVVDNILNNAIKYSPDGGKITVRMKTTEDQMILSISDHGLGIPKQDLPRIFDRFYRVDRARSRAQGGTGLGLSIAKEIIKQHKGFIWAKSEYGKGSTFTIVLPYDKDAVKEEVWEDEVED

SEQ ID NO: 316 - protein, 193 aa, Streptococcus pneumoniae
MSGLLYHTSVYAVKKEILVNTRKKTQFMTMTALLTAIAILIPIVMPFKIVIPPASYTLGSHIAIFIAMFLSPLMAVFVILASSFGFLMAGYPMVIVFRAFSHISFGALGALYLQKFPDTLDKPKSSWIFNFVLAVVHALAEVLACVVFYATSGTNVENMFYVLFVLVGFGTIIHSMVDYTLALAVYKVLRKRR

SEQ ID NO: 317 - protein, 269 aa, Streptococcus pneumoniae
MKNKRIFKDFQASKMSLNIYTSPLLAFVFVFIGEFVAFTLYGIGLLALIGLARNFGEAGQNLASYLQTLHQSLTDKTSDFRLILGLLAFGFILNTVFRWTRKVEKRPIRTLGFYRENFLSNLLKGFSLGLALFLLTLLGLVVLGQYRLESIHLNPYSLAFVVFTIPFWILQGTAEEVVARAWLLPQLASRTNLKLAILISSLFFTLLHMGNSGLTPLSLVNLFLFGVAMALYLLKTDTVWGVAGIHGAWNFAQGNLFGILVSGQPSERL

SEQ ID NO: 318 - protein, 721 aa, Streptococcus pneumoniae
MKKKFLAFLLILFPIFSLGIAKAETIKIVSDTAYAPFEFKDSDQTYKGIDVDIINKVAEIKGWNIQMSYPGFDAAVNAVQAGQADAIMAGMTKTKEREKVFTMSDTYYDTKVVIATTKSHKISKYDQLTGKTVGVKNGTAAQRFLETIKDKYGFTIKTFDTGDLMNNSLSAGAIDAMMDDKPVIEYAINQGQDLHIEMDGEAVGSFAFGVKKGSKYEHLVTEFNQALSEMKKDGSLDKIIKKWTASSSSAVPTTTTLAGLKAIPVKAKYIIASDSSFAPFVFQNSSNQYTGIDMELIKAIAKDQGFEIEITNPGFDAAISAVQAGQADGIIAGMSVTDARKATFDFSESYYTANTILGVKESSNIASYEDLKGKTVGVKNGTASQTFLTENQSKYGYKIKTFADGSSMYDSLNTGAIDAVMDDEPVLKYSISQGQKLKTPISGTPIGETAFAVKKGANPELIEMFNNGLANLKANGEFQKILDKYLASESSTASTSTVDETTLWGLLQNNYKQLLSGLGITLALALISFAIAIVIGIIFGMFSVSPYKSLRVISEIFVDVIRGIPLMILAAFIFWGIPNFIESITGQQSPINDFVAGTIALSLNAAAYIAEIVRGGIQAVPVGQMEASRSLGISYGKTMRKIILPQATKLMLPNFVNQFVIALKDTTIVSAIGLVELFQTGKIIIARNYQSFKMYAILAIFYLVIITLLTRLAKRLEKRIR

SEQ ID NO: 319 - protein, 246 aa, Streptococcus pneumoniae
MAKLKIDVNDLHKHYGKNEVLKGITTKFYEGDVVCIIGPSGSGKSTFLRSLNLLEEVTSGHITVNGYDLTEKTTNVDHVRENIGMVFQHFNLFPHMSVLDNITFAPIEHKLMTKEEAEELGMELLEKVGLADKANANPDSLSGGQKQRVAIARGLAMNPDIMLFDEPTSALDPEMVGDVLNVMKELAEQGMTMIIVTHEMGFARQVANRVIFTADGEFLEDGTPDQIFDNPQHPRLKEFLDKVLNV

SEQ ID NO: 320 - protein, 119 aa, Streptococcus pneumoniae
MRIIYLIIGFLSLTLAIVGVVLPLLPTTPFLLLSIACFSRSSKRFEDWLYHTKLYQAYVADFRETKSIARERKKKIIVSIYVLMGISIYFAPLLPVKIGLGALTIFITYYLFKVIPDKE

SEQ ID NO: 321 - protein, 162 aa, Streptococcus pneumoniae
MSYLRFFFAFFILLAIRFMDCFMANSPILPFKPPPNIWLISGIPAPPRADKSGIPPCPIIPSRADISIPPIFGIFLGRLFGLIPICFIILFISPDITPCMSCLAWLKSLMNLLTSTNVFPEPAAIRRRRLGFNKSGFSRSSGVIEDTMARLRAIWRSSTFMF

SEQ ID NO: 322 - protein, 124 aa, Streptococcus pneumoniae
MKKEQFYPLGIFLAAMLGGLVRYLVSTWLPASPDFPWGTLFVNYLGIFCLIYLVKGYLVYKGTSKGLILALGTGFCGGLTTFSSLMLDTVKLLDTGRYLSLILYLLLSIGGGLLLAYYLGRKKW

SEQ ID NO: 323 - protein, 663 aa, Streptococcus pneumoniae
MAISQMKRISLLFSKSSLDDVLKTIQELESVQFRDLKVQDNWSEALEKDEVVFPTIQIFHTSNSNHGVIEGNDALTYLMNQQQHLEATVEKLQEYLPKENTFKLLQQPPITTSYEELEKFGKANVAEGVLKKVNHQINRVHELERHIQSNNEEIERLIKWEKLEIVPANLEQFSFCKGKVGTIPRTEDNRLYNSLLENNIEVQEIFSNDREYGVVVFYQSSYSIDFDEYLFEPFDYSRKELPKQRVVDLDQENMQLITEKENIIASLQDSKKYLIDLQWQIDYILSIYARQISKNNFLCTPHLVALEGWIEETRILYFIKVMDEHFGHSIYIYESETLTDNQDEIPIKLTNHSLIEPFELLTEMYALPKYYEKDPTPVLAPFYFTFFGMMVADLGYGLLLFLGTMLALKIFHLPSATKRFLKFFNILGVAVAIWGGIYGSFFGYELPFHLISTTSDVMTILVVSVVFGFITVFAGLLASGLQKVRMNKYAEAYNSGFAWCVILLGLLFIAVGMLMPDMRPLFVLGKWVSIFNAVGILIVSIIQTKSLSGIGAGLFNLYNISSYIGDLVSFTRLMALGLSGASIASAFNLIVGLFPGILAKLTIGLVLFILLHAINIFLSLLSGYVHGARLIFVEFFGKFYEGGGKPFQPLKASEKYIKVITKN

SEQ ID NO: 324 - protein, 296 aa, Streptococcus pneumoniae
MKIIGIDIGGTTIKADLYDEFGTSLNHFKEIETIIDYDLGTNQILNQVCDLIGEYTLNHSIDGVGISTAGVVNANTGEIIYAGYTIPGYIGVNFTAEIEKRFGLYTFVENDVNCAALGELWKGQAKDKKNVVMVTIGTGIGGSIIVNGQIVNGFNYTAGEVGYIPVGNSDWQSKASTTALIHLYQKKSLKTNQTGRTFFTDLRSGDKVAEETFEIFVENLTKGLLTISYLLNPEILILGGGILDSKDILLPEIQSSLAKNAMDNRFLPKNLVAATLGNEAGRIGAVKNFLDRISNK

SEQ ID NO: 325 - protein, 305 aa, Streptococcus pneumoniae
MKDLTKYKGVIPAFYACYDENGEISQDRVKSLVQYFIDKGVKGIYVNGSSGECIYQSVEDRKQIIEAVMEVAKGKLTVINHIACNNTKDSIELAKHSESVGVDAIAAIPPIYFKLPEYSIAAYWNAMSEAASNTDFIIYNIPQLAGVALTGSLYATMRQNPRVIGVKNSSMPVQDIQMFVAAGGEDYIVFNGPDEQYLGGRLMGAEAGIGGTYGVMPDLFLKLESLIQERDLDTAKKLQYAINEVIYKMISGKANMYAVAKEVLRLNEKLDLGSVRQPLEALAEGDLEVAKQAAELIQQARKEFL

SEQ ID NO: 326 - protein, 252 aa, Streptococcus pneumoniae
MIGGKNMDKDYILKVKGLYHQFLLGNNKTLQVLKNVSLSASRGEFISILGISGSGKSTLLKCISSLLEPTSGEVILNGINPYKIRNAKLSSIRRNEVSFIFQAYNLIPSLPVIENIALPLRLSQKKLTIKNVENLLKRMKFNAGLNDFVGTLSGGEQQKVAIARAVIADSDIIFADEPTGALDSVSREVIFELLRELVGAGKCVIMVTHDIELASKTDRALILKDGKIFKELHRPSGEELYKILEVQSTTEE

SEQ ID NO: 327 - protein, 535 aa, Streptococcus pneumoniae
MNYLKFIKKTKLILMGILIFLSSFNGVLLSGIIVYAGSLNQTSSFSDVLRFGAISILGWSAIYISNYYLEVTEASITKDINVKIKQGYFREQYLSSEMVKDYSSIISVLSNDLRLIEENYFRQIFEIISSILLFIVSLSFMLYLNFLVSIIFIVLSALPIIVPVFMKKMLSNSANEYSNSNAEYTHIIKEIFNGFKTLKSYSVTKEIISLSDKKLDKLEDSTFNLKRSEVLSKLVAVLISGFCFLVPLVVGCYFVIYHKSLSFSELIGIFLANDKVLGPIQSIAYSLNKINTTKDLRKPFLKYLSGEKNFIDAEHDNNGLYTSSIDEIHMKDVVYSITPENKLSIDFSFKSPFRVLLTGTSGSGKTTILNLINGSLKPQKGYVNLLSHGKKSSDSIPTVDQTPYIFDTTIRENVTLFQNEYFSDDQIIEVLKKVNLYEELEKIDILNYQCGENGSNLSGGQKQKIALARALIRNNKVYLFDEISANLDNDNSNSIHDILFNLGISFIEVSHHYDLNDKRYTDIYKLENGTLFKIK

SEQ ID NO: 328 - protein, 646 aa, Streptococcus pneumoniae
MNQSNEIFLNTIQEKTHYKRSISSSFQELKKWNSLIFRRGRYWYQFDNWSIPNTGVIKEWYVEDNDWIPKVSSSSLDNSNSLKIVFDVEKYTLPDDSILQDVRISSDESYIVLVVSSLRTTNLIGIKKYTMEELFIIEDISVESSFYLGKFGVMYTRSKEYGRPSKLFYKSFDSFTEEELFEENECSFRLKIVHIDSNNCFVKSVDFQKGRIFLYSFDRTGFVRHSYTETVAPTPRDIALFSTEKAQYFLGLSSTEEKKDQLILRETSSGDRVSITIPYQDRARRVHCIGRYILLDCSNAANSVFYLATFKNNSLRELSVNKITFDEKTTLYENSFSDRVLLFLERRTFYEKILSFDLIENTLKTEFERPIIKSNNTKYFSKVIWTKKDSYDVSIPISLFWKSEDTDELPRRKKCILSVYGAYGKNDNSDLDEIMLSIIDAGFIYAIVHVRGGGYLGGEWYRSGKALNKWNSIRDFIEGVNYLRENDVIDSKRLGLITSSAGGIIAGAVLNEEKNLLQSILLFSPFINPYDTLQNPNDPLSKTEIAEWGDIRDPEVKAYIKSYSPMQNIEKARDSNTVIVNILGEKDPYINNNEVIEWSKKLNSIGVKSLLYLNKAAGHGGFTPSDVLLMIDTLNYFFEEVGRNNL

SEQ ID NO: 329 - protein, 477 aa, Streptococcus pneumoniae
MIDGKRLLFSLTIVSYALTLVSGIVYLFNNNNVSLLSTLLFLLVSSLIACWNDIKYYLIHFIFYLTIFVFLVSRPTIDYFRDGALDTYHPIAYRFAFIVVMISILGLTTGGILARYFIARKKIKVANIGNSLKEVYIKRLRFVSLGVFLLTYPFYFIRLFERLLYRLQTSYYAYYANFESKLPYFTYILSTFTVYAMCMYLATKPKKLQATAVLVSFIAANTIHLAIGTRNPFILSILFAFVYYFMREQTEKGKWIGFKEKLAIFVGSPILMLAMGVLNYVRDNVQVSHTGFWDILLDFIYKQGTSFGVLARGFLFNSSLPYRDFRNFTFGPVLDYFARGSLGAIFGGKAFEHTTNSVELAIDSNSYAHNLSYLVLNKEYLKGHGIGSSYIMELYTDYGMIGVFLLSFLLGVLFIAMLQVAYRSRTILFALSLLILNNLFFMPRSSFSESFFNLFTMQFWGIVLVIIFVAKMLTKEN

SEQ ID NO: 330 - protein, 275 aa, Streptococcus pneumoniae
MQSRRKEMKKTSSKLFVVPYMLWIALFVLAPLVLIFGQSFFNIEGQFSLENYKSYFASQNLTYLKMSFNSVLYAGIVTFVALLISYPTALFLTRLKHRQLWLMLIILPTWINLLLKAYAFIGIFGQNGSINQFLEFIGIGSQQLLFTDFSFIFVASYIELPFMILPIFNVLDDMDNNLINASYDLGATKWETFRHVIFPLSMNGVRSGVQSVFIPSLSLFMLTRLIGGNRVITLGTAIEQNFLTNDNYGMGSTIGVILILTMFITMWVTKERRER

SEQ ID NO: 331 - protein, 252 aa, Streptococcus pneumoniae
MTDAILQVSDLSVYYNKKKALNSVSLSFQPKEITALIGPSGSGKSTLLKSLNRMGDLNPEVTTTGSVVYNGHNIYSPRTDTVELRKEIGMVFQQPNPFPMTIYENVVYGLRINGIKDKQVLDEAVEKALQGASIWDEVKDRLYDSAIGLSGGQQQRVCVARVLATSPKIILLDEPTSALDPISAGKIEETLYGLKDKYTMLLVTRSMQQASRISDKTGFFLDGDLIEFNDTKQMFLDPQHKETEDYITGKFG

SEQ ID NO: 332 - protein, 294 aa, Streptococcus pneumoniae
MRAKKLDKLATAVLYTIASIIVTILASLILYILVRGLPHISWSFLTGRSSAFQAGGGIGIQLYNSFFLLVITLIISVPLSMGAGIYLAEYAKKGPVTNFVRTCIEILSSLPSVVVGLFGYLIFVVQFEYGFSIISGALALTVFNLPQMTRNVEDSLKHVHHTQREAGLALGISRWETVVHVVIPEALPGIVTGVVLASGRIFGEAAALIYTAGQSAPALDWSNWNILSVTSPISIFRQAETLAVHIWKVNSEGTIPDGTIVSAGSAAVLLIFILIFNFGARKFGSYLHKKLTAA

SEQ ID NO: 333 - protein, 586 aa, Streptococcus pneumoniae
MLMKIYKKLFAYVQDKKYLGVLAIIFSAISAALTVYGYYLIYKFLDKLIINSNLSGAESIALKSVITLTSGAIFYFVSGMFSHILGFRLETNLRKRGIDGLEKASFRFFDLNPSGQIRKIIDDNAAQTHQVVAHMIPDSSQAIITPVLVLALGFIVSIRVGIILLALTIIGGLILGAMMGEQEFMKIYQESLSKLSAETVEYVRGMQVVKIFKANVESFKSFYKAIKDYSKYAYDYSLSCKRPYVLYQWLFFGLIAILIIPIVYFMTSLASAKVILLELIMILFLSGVLFVSFMRMMWYSMYISQGNYAVDTLEALYEDMQKDKLVHGNVNNFKNYNIEFENVSFAYNDKAVIENLSFNLEEGKSYALVGSSGSGKSTVAKLISGFYNVNKGSIKIGGIAISEYSDEALIKAISFVFQDSKLFKKSIYDNVALANKDATKDDVMRALKLAGCDLILDKFPERENTIIGSKGVYLSGGEKQRIAIARAILKDSKIIIMDEASASIDPDNEFELQKAFKNLMKDKTVIMIAHRLSTIKDLDEIIVMDSGKIIERGSDKELMSKDTRYKSLQEMFNSANEWRVSNERVL

SEQ ID NO: 334 - protein, 581 aa, Streptococcus pneumoniae
MRMNGGFQMKEFYKKRFALTDGGARNLSKATLASFFVYCINMLPAILLMIFAQEVLENMGKSNGFYIVFSVLILIAMYILLSIEYDKLYNTTYQESADLRIRTAENLSKLPLSYFSKHDISDISQTIMADIEGIEHAMSHSIPKVGGMVLFFPLISVMMLAGNVKMGLAVIIPSILSFIFIPLSKKYQVNGQNRYYDVLRKNSESFQENIEMQMEIKAYNLSKDIKDDLYKKMEDSEKVHLKAEVTTILTLSISSIFSFISLAVVIFVGVNLIINKEINSLYLIGYLLAAMKIKDSLDASKEGLMEIFYLSPKIERLKEIQNQDLQEGDDYSLKKFDIDLKDVEFAYNKDAKVLNGVSFKAKQGEVTALVGASGCGKTTILKLISRLYDYDKGQILIDGKDIKEISTESLFDKVSIVFQDVVLFNQSVMENIRIGKQDASDEEVKRAAKLANCTDFIEKMDKGFDTVIGENGAELSGGERQRLSIARAFLKDAPILILDEITASLDVNNEKKIQESLNNLVKDKTVVIISHRMKSIENADKIVVLQNGRVESEGKHEELLQKSKIYKNLIEKTKMAEEFIY

SEQ ID NO: 335 - protein, 209 aa, Streptococcus pneumoniae
MDNKKLKVKDLVSIGVFGVIYFAFMFGVGMMGLIPILFLIYPTVLAIVAGTVVMLFMAKVQKPWALFIFGMISPLVMFAAGHTYVVVVLSLIVMIIAELIRKIGNYNSFKYNMLSYAIFSTWICSSLMQMLLAKEKYMEWSLMTMGKDYVDVLEKLITYPHMALVALGAFLGGILGAYIGKALLKKHFSNGLYCVGYFTPCLILWCYLN

SEQ ID NO: 336 - protein, 169 aa, Streptococcus pneumoniae
MCGILYSLPNFMVLSELNPIVKMFLSIPIVIRMFILPFMAASFMIKTSDVGAIISSMDKLKISKNVSIPIAVMFRFFPSFKEEKKNIKMAMRVRGINFKNPVKYLEYVSVPLLIISSNISDDIAKAAETKAIENPIAKTRYIRVKIQLIDFVYVLAVAGLIVGGLIWLK

SEQ ID NO: 337 - protein, 374 aa, Streptococcus pneumoniae
MVEIKNLSLDYGEEHILDDISLSIAEGECVLFTGKSGNGKSSLINSINGLAVRYDNAKTKGEIIIDGKNIKNLELYQISMLVSTVFQNPKTYFFNVNTTLELLFYLENIGLAREEMDRRLKDILEIFPIKNLLNRNIFNLSGGEKQILCIAASYIAGTKIIVMDEPSSNLDIKSISVLAKMLKILKEKGISIIVAEHRIYYLMDIVDRVFLIDKGKLKKTYTRSEFLKLDKNELNALSLRDKELSKLKVPYLKEGGEYQIKNLSYKFTDDECLSLKDISFKLGKIYGIIGSNGRGKSTLLRCLIGLEKKSKEEIYFKGEKLSKKERLKNSSLVMQDVNHQLFTDEVFNELRLGVKNFDEEKAKIILNPNYSPQI

SEQ ID NO: 338 - protein, 75 aa, Streptococcus pneumoniae
MSLSGGQKQRLAIASVMCKNSPFVFFDEPSSGMDYSNMIKISELINKYKTMDKIIFIVSHDIEFLNEVADEIFEL

SEQ ID NO: 339 - protein, 318 aa, Streptococcus pneumoniae
MDIRPQSSDELDSQRRVRRDMSNSLKGTLLTVVAGIAWGLSGTSGQYLMAHGISALVLTNLRLLIAGGILMLLAYATAKDKILVFLKDRKSLLSLLIFALIGLFLNQFAYLSAIQETNAGTATVLQYVCPVGILIYSCIKDRVAPTLGEIVSIIFAIGGTFLIATHGQLDQLSMTPAGLFWGLFSALTYALYIILPIALIKKWGSSLVIGVGMVIAGLVALPFTGVLQADIPTSLDFLLAFAGIILIGTVFAYTAFLKGASLIGPVKSSLLASIEPISAIFFAFLIMNEQFYPIDFLGMAMILFAVTLISLKDLFLEK

SEQ ID NO: 340 - protein, 79 aa, Streptococcus pneumoniae
MLLLAKEKVACLLTVTCLAMLFAMPALLLTTLTKMEKNTVSNSKATTPLLFSMKLTTLTVSCFTIASMKKTHLQLKMVY

SEQ ID NO: 341 - protein, 78 aa, Streptococcus pneumoniae
MREIMLLQLFSLYFESLILTTILVLIFLGIWIGLRAMSGVDKTARARQAHLYDMIMIGVLVVPVLSFAVMSLILVFKA

SEQ ID NO: 342 - protein, 176 aa, Streptococcus pneumoniae
MQKKYVKILYSSPIGILSLVADDHYLYGIWVQEQKHFERGLGDETIEEVVSHPILDPVIACLDDYFKGKPQDLSNLLLAPIGTNFEKRVWDYLQGIPYGQTVTYGQIAQDLQVASAQAIGGAVGRNPWSILVPCHRVLGAGKRLTGYAAGVEKKAWLLEHEGVDFKDRSNRRRSTC

SEQ ID NO: 343 - protein, 480 aa, Streptococcus pneumoniae
MPNCIIEIIAQICYDINMNKSRLGRGRHGKTRHVLLALIGILAISICLLGGFIAFKIYQQKSFEQKIESLKKEKDDQLSEGNQKEHFRQGQAEVIAYYPLQGEKVISSVRELINQDVKDKLESKDNLVFYYTEQEESGLKGVVNRNVTKQIYDLVAFKIEETEKTSLGKVHLTEDGQPFTLDQLFSDASKAKEQLIKELTSFIEDKKIEQDQSEQIVKNFSDQDLSAWNFDYKDSQIILYPSPVVENLEEIALPVSAFFDVIQSSYLLEKDAALYQSYFDKKHQKVVALTFDDGPNPATTPQVLETLAKYDIKATFFVLGKNVSGNEDLVKRIKSEGHVVGNHSWSHPILSQLSLDEAKKQITDTEDVLTKVLGSSSKLMRPPYGAITDDIRNSLDLSFIMWDVDSLDWKSKNEASILTEIQYQVANGSIVLMHDIHSPTVNALPRVIEYLKNQGYTFVTIPEMLNTRLKAHELYYSRDE

SEQ ID NO: 344 - protein, 232 aa, Streptococcus pneumoniae
MVILFIHAIIGTITFRRCSMSYLFEILPSLLNGASTTVQVFALVLLFSIPLGVLIAFALQVHWKPLHYLINIYIWVMRGTPLLLQLIFIYYVLPSIGIRLDRLPAAIIAFVLNYAAYFAEIFRGGIDTIPRGQYEAAKVLKFSPFDRVRYIILPQVTKIVLPSVFNEVMSLVKDTSLVYALGISDLILASRTAANRDASLVPMFLAGAIYLILIGIVTIISKKVEKKYSYYR

SEQ ID NO: 345 - protein, 238 aa, Streptococcus pneumoniae
MEESINPIISIGPVIFNLTMLAMTLLIVGVIFVFIYWASRNMTLKPKGKQNVLEYVYDFVIGFTEPNIGSRYMKDYSLFFLCLFLFMVIANNLGLMTKLQTIDGTNWWSSPTANLQYDLTLSFLVILLTHIESVRRRGFKKSIKSFMSPVFVIPMNILEEFTNFLSLALRIFGNIFAGEVMTSLLLLLSHQAIYWYPVAFGANLAWTAFSVFISCIQAYVFTLLTSVYLGNKINIEEE

SEQ ID NO: 346 - protein, 551 aa, Streptococcus pneumoniae
MSEKSREEEKLSFKEQILRDLEKVKGYDEVLKEDEAVVRTPANEPSTEELMADSLSTVEEIMRKAPTVPTHPSQGVPASPADEIQRETPGVPSHPSQDVPSSPAEESGSRPGPGPVRPKKLEREYNETPTRVAVSYTTAEKKAEQAGPETPTPATETVDIIRDTSRRSRREGAKPVKPKKEKKSHVKAFVISFLVFLALLSAGGYFGYQYVLDSLLPIDANSKKYVTVGIPEGSNVQEIGTTLEKAGLVKHGLIFSFYAKYKNYTDLKAGYYNLQKSMSTEDLLKELQKGGTDEPQEPVLATLTIPEGYTLDQIAQAVGQLQGDFKESLTAEAFLAKVQDETFISQAVAKYPTLLESLPVKDSGARYRLEGYLFPATYSIKESTTIESLIDEMLAAMDKNLSPYYSTIKSKNLTVNELLTIASLVEKEGAKTEDRKLIAGVFYNRLNRDMPLQSNIAILYAQGKLGQNISLAEDVAIDTNIDSPYNVYKNVGLMPGPVDSPSLDAIESSINQTKSDNLYFVADVTEGKVYYANNQEDHDRNVAEHVNSKLN

SEQ ID NO: 347 - protein, 222 aa, Streptococcus pneumoniae
MLTYGGYRVSAGYISVGTLVSFLIYLFQLLNPISNIANFVTVYSRSKGSSVALENLLAVPKEKFEGGKSVSGRGLNFNHVYFGYDENRPVLKDITCSIFKGQKIAFVGPSGSGKSTIVRLLERFYKPLSGDILMEQSSIYDFNLKEWRSKIAWVSQNNAVLSGSIRDNLCLGLNRLVTDDELMKVLDLVSLGDEIRSMKEGLDTEVGERGRLLSGGRTKDFK

SEQ ID NO: 348 - protein, 181 aa, Streptococcus pneumoniae
MKLKLLRVDTKVIMGSFLLVLSSLLALLLPLILKDLIDGSSIENIGSKVFQSFLIFIGQALFSSIGYYLFSQSGEKKIAKIRKKVIEGLIYVEKSFFDKSQSGELTSAIVNDTSVIREFLITTFPNIILSLVMVLGSIVVLFSLDWNLSLLLFITLPCMMFIILPLSNISEKYSRRLQEEI

SEQ ID NO: 349 - protein, 652 aa, Streptococcus pneumoniae
MKKSKSKYLTLAGLVLGTGVLLSACGNSSTASKTYNYVYSSDPSSLNYLAENRAATSDIVANLVDGLLENDQYGNIIPSLAEDWTVSQDGLTYTYKLRKDAKWFTSEGEEYAPVTAQDFVTGLQYAADKKSEALYLVQDSVAGLDDYITGKTSDFSTVGVKALDDQTVQYTLVKPELYWNSKTLATILFPVNADFLKSKGDDFGKADPSSILYNGPFLMKALVSKSAIEYKKNPNYWDAKNVFVDDVKLTYYDGSDQESLERNFTAGAYTTARLFPNSSSYEGIKEKYKNNIIYSMQNSTSYFFNFNLDRKSYNYTSKTSDIEKKSTQEAVLNKNFRQAINFAFDRTSYGAQSEGKEGATKILRNLVVPPNFVSIKGKDFGEVVASKMVNYGKEWQGINFADGQDPYYNPEKAKAKFAEAKKELEAKGVQFPIHLDKTVEVTDKVGIQGVSSIKQSIESVLGSDNVVIDIQQLTSDEFDSSGYFAQTAAQKDYDLYHGGWGPDYQDPSTYLDIFNTNSGGFLQNLGLEPGEANDKAKAVGLDVYTQMLEEANKEQDPAKRYEKYADIQAWLIDSSLVLPSVSRGGTPSLRRTVPFAAAYGLTGTKGVESYKYLKVQDKIVTTDEYAKAREKWLKEKEESNKKAQEELAKHVK

SEQ ID NO: 350 - protein, 545 aa, Streptococcus pneumoniae
MNEESMSHENNHQQAQMLRGTAWLTASNFISRLLGAVYIIPWYIWMGAYAAKANGLFTMGYNIYAWFLLVSTAGIPVAVAKQVAKYNTMREEEHSFALIRSFLGFMTGLGLVFALVLYVFAPWLADLSGVGKDLIPIMQSLAWGVLIFPSMSVIRGFFQGMNNLKPYAMSQIAEQVIRVIWMLLATFIIMKLGSGDYLAAVTQSTFAAFVGMVASFAVLIYFLAQEGSLKRIFETGDKINSKRLLVDTIKEAIPFILTGSAIQLFQILDQLTFINSMSWFTNYSNEDLVVMFSYFSANPNKITMILISVGVSIGSVGLPLLTENYVKGDLKAASRLVQDSLTLLFMFLLPATVGVVMVGEPLYTVFYGKPDSLALGLFVFAVLQSIILGLYMVLSPMLQAMFRNRKAVLYFIYGSIAKLVLQLPTIALFHSYGPLISTTIALIIPNVLMYRDICKVTGVKRKVILKRTILISLLTLVMFLLIGTIQWLLGFFFQPSGRLWSFFYVALVGAMGGGLYMVMSLRTYLLDKVIGKAQADRLRAKFKLS

SEQ ID NO: 351 - protein, 209 aa, Streptococcus pneumoniae
MQVLLFCCNIFYNNERVLEILRKRRHIMSKKVLFIVGSLRQGSFNHQMALEAEKALAGKAEVSYLDYSALPLFSQDLEVPTHPAVAAAREAVLVADAIWIFSPVYNFSIPGTVKNLLDWLSRALDLSDTRGVSALQDKFVTVSSVANAGHDQLFAIYKDLLPFIRTQGVGDFTAARVNDSAWADGKLVLEETVLNSLEKQAQDLVEAIK

SEQ ID NO: 352 - protein, 623 aa, Streptococcus pneumoniae
MSDFIVEKLSKSVGDKTVFRDISFIIHDLDRIGLIGVNGTGKTTLLDVLSGVSGFDGDVSPFSAKNDYQIGYLTQDPDFDDRKTVLDTVLSSELKEIQLIREYELIMLDYSEDKQARLERVMAEMDSLQAWEIESQVKTVLSKLGIQDLSTPVGELSGGLRRRVQLAQVLLGNHDLLLLDEPTNHLDIAIIEWLTLFLKNSKKTVLFITHDRYFLDALSTRIFELDRAGLTEYQGNYQDYVRLKAEQDERDAALLHKKEQLYKQELAWMRRQPQARATKQQARINRFHDLKKEVSGSSAETDLTMNFETSRIGKKVIEFQDVSFAYENKPILQNFNLLVQAKDRIGIVGDNGVGKSTLLNLIAGSLEPTAGQVVIGETVRIAYFSQQIEGLDESKRVINYLQEVAEEVKTSGGSTTSIAELLEQFLFPRSTHGTLIEKLSGGEKKRLYLLKLLLEKPNVLLLDEPTNDLDIATLTVLENFLQGFAGPVLTVSHDRYFLDKVATKILAFEDGKIRPFFGHYTDYLDEKAFETDMANQVQKAEKEKVVKVREDKKRMTYQEKQEWASIEGDIETLEKRIAAIEEEMQANGSDFGKLATLQKELDEKNEALLEKYERYEYLSEFDS

SEQ ID NO: 353 - protein, 178 aa, Streptococcus pneumoniae
MNEVKKMVELKKEAVKDVTSLTKAAPVALAKTKEVLNQAVADLYVAHVALHQVHWYMHGRGFLVWHPKMDEYMEALDGQLDEISERLITLGGSPFSTLTEFLQNSEIEEEAGEYRNVEESLERVLVIYRYLSELFQKGLDVTDEEGDDVTNGIFAGAKTETDKTIWMLAAELGQAPGL

SEQ ID NO: 354 - protein, 356 aa, Streptococcus pneumoniae
MFGLIGCIYGAFGRKIWSESHGKSICFSIRRWKYLNRICNRPSELWLLYLAYGILGGLGLGAGYITPVSTIIKWFPDKRGLATGLAIMGFGFASLLTSPIAQHLIAGVGLVETFYILGASYFIIMLLASQFIKRPNEQELAILSSSGKEKTASLTQGMAANQALKSNRFYMLWIIFFINIACGLGLISAASPMAQEMAGLSTSHAAVMVGVLGIFNGFGRLLWASLSDYIGRPLTFSILLLVNLFFSLSLWLFTDSVLFVVAMSILMTCYGAGFSLIPAYLSDIFGTKELAALHGYILTAWAMAGLAGPILLAETYKMAHSYTQTLFVFLILYSIALALSYYLGRSIKKESQKALT

SEQ ID NO: 355 - protein, 153 aa, Streptococcus pneumoniae
MKQTKTTKIALVSLLTALSVVLGYFLKIPTPTGILTLLDAGVFFAAFYFGSREGAVVGGLASFLIDLLSGYPQWMFFSLVNHGLQGFFAGFKGKSQWLGLILATIAMVGGYALGSALMNGWAAALPEILPNFMQNMVGMIVGFILSQSIKKIK

SEQ ID NO: 356 - protein, 225 aa, Streptococcus pneumoniae
MISKRLELVASFVSQGAILLDVGSDHAYLPIELVERGQIKSAIAGEVVEGPYQSAVKNVEAHGLKEKIQVRLANGLAAFEETDQVSVITIAGMGGRLIARILEEGLGKLANVERLILQPNNREDDLRIWLQDHGFQIVAESILEEAGKFYEILVVEAGQMKLSASDVRFGPFLSKEVSPVFVQKWQKEAEKLEFALGQIPEKNLEERQVLVDKIQAIKEVLHVSK

SEQ ID NO: 357 - protein, 108 aa, Streptococcus pneumoniae
MEGIRMKIVGVAACTVGIAHTYIAQEKLENAAKVAGHVIHVETQGTIGVENELSQEQIDAADVVILAVDVKISGMERFEGKKIIKVPTEVAVKSPNKLIAKAVEIVTK

SEQ ID NO: 358 - protein, 240 aa, Streptococcus pneumoniae
MIRIENLSVSYKETLALKDISLVLHGPTITGIIGPNGAGKSTLLKGMLGIIPHQGQAFLDDKEVKKSLHRIAYVEQKINIDYNFPIKVKECVSLGLFPSIPLFRSLKAKHWKKVQEALEIVGLADYAERQISQLSGGQFQRVLIARCLVQEADYILLDEPFAGIDSVSEEIIMNTLRDLKKAGKTVLIVHHDLSKIPHYFDQVLLVNREVIAFGPTKETFTETNLKEAYGNQLFFNGGDL

SEQ ID NO: 359 - protein, 294 aa, Streptococcus pneumoniae
MTYYVAIDIGGTNIKYGLVDQEGQLLESHEMPTEAHKGGPHILQKTKDIVASYLEKGPVAGVAISSAGMVDPDKGEIFYAGPQIPNYAGTQFKKEIEESFTIPCEIENDVNCAGLAEAVSGSGKGASVTLCLTIGTGIGGCLIMDRKVFHGFSNSACEVGYMHMQDGAFQDLASTTALVKYVAEAHGEDVDQWNGRRIFKEATEGNKICMEGIDRMVDYLGKGLANICYVANPEVVILGGGIMGQEAILKPKIRTALKEALVPSLAEKTRLEFAHHQNTAGMLGAYYHFKTKQS

SEQ ID NO: 360 - protein, 214 aa, Streptococcus pneumoniae
MAQKGVSLIKAAFDTDNFLMRFSEKVLDIVTANLLFVVSCLPIVTIGVAKISLYETMFEVKKSRRVPVFKIYLRSFKQNLKLGLQLGLMELGIVFLTLSDLYLFWGQTALPFQLLKAICLGILIFLTIVMLASYPIAARYDLSWKEILQKGLMLASFNFPWFFLMLAILVLIVMVLYLSAFSLLLGGSVFLLFGFGLLVFIQTGLMEKIFAKYQ

SEQ ID NO: 361 - protein, 294 aa, Streptococcus pneumoniae
MVKERNLTRWIFVLPAMIIVGLLFVYPFFSSIFYSFTNKHLIMPNYKFVGLANYKAVLSDPNFFNAFFNSIKWTVFSLVGQVLVGFVLALALHRVRHFKKLYRTLLIVPWAFPTIVIAFSWQWILNGVYGYLPNLIVKLGLMEHTPAFLTDSTWAFLCLVFINIWFGAPMIMVNVLSALQTVPEEQFEAAKIDGASSWQVFKFIVFPHIKVVVGLLVVLRTVWIFNNFDIIYLITGGGPANATTTLPIFAYNLGWGTKLLGRASAVTVLLFIFLVAICFIYFAIISKWEKEGRK

SEQ ID NO: 362 - protein, 445 aa, Streptococcus pneumoniae
MKKMRKFLCLAGIALAAVALVACSGKKEATTSTEPPTELSGEITMWHSFTQGPRLESIQKSADAFMQKHPKTKIKIETFSWNDFYTKWTTGLANGNVPDISTALPNQVMEMVNSDALVPLNDSIKRIGQDKFNETALNEAKIGDDYYSVPLYSHAQVMWVRTDLLKEHNIEVPKTWDQLYEASKKLKEAGVYGLSVPFGTNDLMATRFLNFYVRSGGGSLLTKDLKADLTSQLAQDGIKYWVKLYKEISPQDSLNFNVLQQATLFYQGKTAFDFNSGFHIGGINANSPQLIDSIDAYPIPKIKESDKDQGIETSNIPMVVWKNSKHPEVAKAFLEALYNEEDYVKFLDSTPVGMLPTIKGISDSAAYKENETRKKFKHAEEVITEAVKKGTAIGYENGPSVQAGMLTNQHIIEQMFQDIITNGTDPMKAAKEAEKQLNDLFEAVQ

SEQ ID NO: 363 - protein, 800 aa, Streptococcus pneumoniae
MSYFRNRDIDIERISMNRSVQERKCRYSIRKLSVGAVSMIVGAVVFGTSPVLAQEGASEQPLANETQLSGESSTLTDTEKSQPSSETELSGNKQEQERKDKQEEKIPRDYYARDLENVETVIEKEDVETNASNGQRVDLSSELDKLKKLENATVHMEFKPDAKAPAFYNLFSVSSATKKDEYFTMAVYNNTATLEGRGSDGKQFYNNYNDAPLKVKPGQWNSVTFTVEKPTAELPKGRVRLYVNGVLSRTSLRSGNFIKDMPDVTHVQIGATKRANNTVWGSNLQIRNLTVYNRALTPEEVQKRSQLFKRSDLEKKLPEGAALTEKTDIFESGRNGNPNKDGIKSYRIPALLKTDKGTLIAGADERRLHSSDWGDIGMVIRRSEDNGKTWGDRVTITNLRDNPKASDPSIGSPVNIDMVLVQDPETKRIFSIYDMFPEGKGIFGMSSQKEEAYKKIDGKTYQILYREGEKGAYTIRENGTVYTPDGKATDYRVVVDPVKPAYSDKGDLYKGDQLLGNIYFTTNKTSPFRIAKDSYLWMSYSDDDGKTWSAPQDITPMVKADWMKFLGVGPGTGIVLRNGPHKGRILIPVYTTNNVSHLDGSQSSRVIYSDDHGKTWHAGEAVNDNRQVDGQKIHSSTMNNRRAQNTESTVVQLNNGDVKLFMRGLTGDLQVATSKDGGVTWEKDIKRYPQVKDVYVQMSAIHTMHEGKEYIILSNAGGPKRENGMVHLARVEENGELTWLKHNPIQKGEFAYNSLQELGNGEYGILYEHTEKGQNAYTLSFRKFNWEFLSKNLISPTEAN

SEQ ID NO: 364 - protein, 210 aa, Streptococcus pneumoniae
MRLEIINGQKIYGKRPILNQLNLVFQSGKIYGLKGDNGSGKTVLLKILAGYIKLDKGKVLQDGKVYGVKNHYIQDAGILIEKVEFLSHLSLRENLELLRYFSSKVTEKRIAYWIQYYDLQEFEDIEYRHLSLGTKQKMALIQAFISSPSILFLDEPMNALDEKSVRLTKQVILSYLKKENGLVILTSHISEDISDLCTDVLVVENGHIQM

SEQ ID NO: 365 - protein, 97 aa, Streptococcus pneumoniae
MRSMTRLASQVSSFPCFTFAKCFSKSSKLKLDVKKVGKFSCIRYWRMTCRISSRTQTVDCSAPISSKIRTSDSLISSTKVLTLPSLIAFLTSMTKLG

SEQ ID NO: 366 - protein, 501 aa, Streptococcus pneumoniae
MIILKEFKPMSLLVFENVSKSYGATPALENVSLDIPAGKIVGLLGPNGSGKTTLIKLINGLLQPDQGRVLINDMDPSPATKAVVAYLPDTTYLNEQMKVKEALTYFKTFYKDFNLERAHHLLADLGIDENSRLKKLSKENKEKVQLILVMSRDARLYVLDEPIGGVDPAARAYILNTIINNYSPTSTVLISTHLISDIEPILDEIVFLKDGKVVRQGNVDDIRYESGESIDQLFRQNLRPKQRRLFMFWNLVRYEFKNVNKWYLALYAAVLVLSALIGIQTQGFKNLPYQESQATMLLFLATVFGGLMLTLGISTIFLIIKRFKGSVYDRQGYLTLTLPVSEHHIITAKLIGAFIWSLISTAVLALSAVIILALTAPEWIPLSYVITFVETHLPQIFLTGISFLLNTISGILCIYLAISIGQLFNEYRTALAVAVYIGIQIVIGFIELFFNLSSNFYVNSLVGLNDHFYMGAGIAIVEELIFIAIFYLGTYYILRNKVNLL

SEQ ID NO: 367 - protein, 381 aa, Streptococcus pneumoniae
MVTPFVTLLVMSILGLFVIGPVFHVVENYILIATKAILSMPFGLGGFLIGGVHQLIVVSGVHHIFNLLEVQLLAADHANPFNAIITAAMTAQGAATVAVGVKTKNPKLKTLAFPAALSAFLGITEPAIFGVNLRFRKPFFLSLIAGAIGGGLASILGLAGTGNGITIIPGTMLYVGNGQLPQYLLMVAVSFALGFALTYMFGYEDEVDATAAAKRAEVAEEKEEVAPAALQNETLVTPIVGDVVALADVNDPVFSSGAMGQGIVVKPSQGVVYAPADAEVSIAFPTGHAFGLKTRNGAEVLIHVGIDTVSMNGDGFETKVAQGNKVKAGDVLGTFDSNKIAAAGLDDTTMVIVTNTGDYASVAPVATGSVAKGDAVIEVKI

SEQ ID NO: 368 - protein, 249 aa, Streptococcus pneumoniae
MQMNNQEIAKKVIDALGGRENVNSVAHCATRLRVMVKDEEKINKEVIENLEKVQGAFFNSGQYQIIFGTGTVNKMYDEVVVLGLPTSSKDDMKAEVAKQGNWFQRAIRTFGDVFVPIIPVIVATGLFMGVRGLFNALEMPLPGDFATYTQILTDTAFIILPGLVVWSTFRVFGGNPAVGIVLGMMLVSGSLPNAWAVAQGGEVTAMNFFGFIPVVGLQGSVLPAFIIGVVGAKFEKAVRKLFQMSLTSW

SEQ ID NO: 369 - protein, 201 aa, Streptococcus pneumoniae
MRLMKIWYNEIKEFYMQKFIQAYIEKLDVTTIIENILTKVISLLLLLIVFYIAKKMLHTMVQRIVKPSLKMSRHDVGRQKTISRLLENVFNYTLYFFLLYCILSILGLPVSSLLAGAGIAGVAIGMGAQGFLSDVINGFFILFERQLDVGDEVVLTNGPITVSGKVVSVGIRTTQLRSEEQALHFVPNRNITVVSNFSRTD

SEQ ID NO: 370 - protein, 598 aa, Streptococcus pneumoniae
MEQKHRSEFPEKELWDLTALYQDREDFLRAIEKAREDINQFSRDYKGNLHTFEDFEKAFAELEQIYIQMSHIGNYGFMPQTTDYSNDEFANIAQAGMEFETDASVALTFFDDALVAADEEVLDRLGKLPHLTAAIRQAKIKKAHYLGADVEKALTNLGEVFYSPQDIYTKMRAGDFEMADFEAHGKTYKNSFVTYENFYQNHEDAEVREKSFRSFSEGLRKHQNTAAAAYLAQVKSEKLLADMKGYDSVFDYLLAEQEVDRVMFDRQIDLIMKDFAPVAQRYLKHVAKVNGLEKMTFADWKLDLDSALNPEVTIDDAYDLVMKSVEPLGQEYCQEVARYQEERWVDFAANSGKDSGGYAADPYRVHPYVLMSWTGRLSDVYTLIHEIGHSGQFIFSDNHQSYFNAHMSTYYVEAPSTFNELLLSDYLENQSNDPRQKRFALAHRLTDTYFHNFITHLLEAAFQRKVYTLIEEGETFGASKLNSIMKEVLTDFWGDAIEIDDDATLTWMRQAHYYMGLYSYTYSAGLVISTAGYLHLKHSETGAEDWLNLLKSGGSKTPLESAMIIGADISTDKPLRDTIQFLSDTVDQIISYSAELGE

SEQ ID NO: 371 - protein, 190 aa, Streptococcus pneumoniae
MYMSKAKKICFIIFCILILTIFLPVLIDYHQVSDLGIHLLSWRQNSVVEFYLARYVFWGTVVLSTLVLLSILVVMFYPKRYLEIQLETKNDTLKLKNSAIEGFVRSLVSDHRLIKNPTVHVNLRKNKCFVHVEGKILPSDNIADRCQIIQNEITNGLKQFFGIERQVKLEVAVKNYQPKPQNKKTVSRVK

SEQ ID NO: 372 - protein, 219 aa, Streptococcus pneumoniae
MIDFYFFLVGSILASFLGLVIDRFPEQSIISSASHCDSCQTPLRPLDLIPILSQVFNRFRCRYCKVRYPVWYALFELSLGLLFLLYSWGWLSLGQVVLITAGLTLGIYDFHHQEYPLLVWMTFQLILIASSGWNLVMVSFLILGILAHFIDIRMGAGDFLFLASCALVFSVTELLILIQFASATGILAFLLQKKKERLPFVPFLLLATCLIIFGKLLLV

SEQ ID NO: 373 - protein, 383 aa, Streptococcus pneumoniae
MFNGRVLKELRLLNGLSRAELAQRINLTEQAIWQFESNETKPKLSTKMHLANQFHVDLTYFEQEEESIRFDSSVIAFRNADLATRKTIDIQTMYLHKVDSLIDYFESFVIIPNIIIHDLSNVVSESYHKGESIEELALYAREKLGISKDNHDLLYKLERSGIYIVERLINGQADAYSAWSKLGRPYIVLGTNKSSVRRNFDLAHELGHILLHKYKDMNEDGDRLEQEANYFASCFLLPKEEFLVKFEERVGKRVSNPDSYILLKSDLNVSIQALEYRAFKLGLLTPKQHSYFYRQIAQKGYKMIEPLDDQIFVKKPSKVKSILDVVLSNHLVSLATIMSKQSIRLQFISEIFSVEMKFFDQYQEDRRTDRFDNIIPLYKRNNL

SEQ ID NO: 374 - protein, 594 aa, Streptococcus pneumoniae
MASGFHLQSERDFMSIIQKLWWFFKLEKRRYLVGIVALILVSVLNLIPPMVMGRVIDAITSGQLTQQDLLLSLFYLLLAAFGMYYLRYVWRMYILGTSYCLGQIMRSRLFKHFTKMSSAFYQTYRTGDLMAHATNDINALTRLAGGGVMSAVDASITALVTLLTMLFSISWQMTLVAILPLPFMAYTTSRLGRKTHKAFGESQAAFSELNNKVQESVSGIKVTKSFGYQADELKSFQAVNELTFQKNLQTMKYDSLFDPMVLLFVGSSYVLTLLVGSLMVQEGQITVGNLVTFISYLDMLVWPLLAIGFLFNTTQRGKVSYQRIENLLSQESPVQDPEFPLDGIENGRLEYAIDSFAFENEETLTDIHFSLAKGQTLGLVGQTGSGKTSLIKLLLREYDVDKGAIYLNGHDIRDYRLTDLRSLMGYVPQDQFLFATSILDNIRFGNPNLPLSAVEEATKLARVYQDIVDMPQGFDTLIGEKGVSLSGGQKQRLAMSRAMILDPDILILDDSLSAVDAKTEYAIIDNLKEMRKDKTTIITAHRLSAVVHADFILVLQNGQIIERGTHEDLLALDGWYAQTYQSQQLEMKGEEDAE

SEQ ID NO: 375 - protein, 655 aa, Streptococcus pneumoniae
MGKFEQEAKDLLQAIGGKENVTAVTHCATRMRFVLGDDKKANVKAIESIPAVKGTFTNAGQFQVIIGNDVPIFYNDFTAVSGIEGVSKEAAKSAAKSNQNVVQGVMTTLAEIFTPIIPALIVGGLILGFRNVLEGVHWSMLDGKTITESSQFWAGVNHFLWLPGEAIFQFLPVGITWSVSRKMGTSQILGIVLGICLVSPQLLNAYAVASTPAADIAANWVWNFGYFTVNRIGYQAQVIPALLAGLSLSYLEIFWHKHIPEVISMIFVPFLSLIPALILAHTVLGPIGWTIGQGLSSVVLAGLTGPVKWLFGAIFGALYAPFVITGLHHMTNAIDTQLIADAGGTALWPMIALSNIAQGSAVFAYYFMHRHDEREAQVSLPATISAYLGVTEPALFGVNVKYIYPFVAGMTGSALAGMLSVTFNVTAASIGIGGLPGILSIQPQYMLPFAGTMLVAIVVPMLLTFFFRKAGLFTKTEGDTNLQAEFVAQEEAEFVNHEPVELTSVEIISPLTGQVKELSQATDPIFASGVMGQGLVIEPSQGELTSPVNGTVTVLFPTKHAIGIVSDEGVELLIHIGMDTVGLDGKGFESLVVQGDHVTVGQQLIRFDMDVIKAAGLVTETPVIITNQDAYTATIPGTYPTTIQAGASLMVATRI

SEQ ID NO: 376 - protein, 175 aa, Streptococcus pneumoniae
MSRVHVQIMNQFHRKSHEYKAIKRYWKLIQQDSRKLSDKRFYRPTFRMHLTNKEILDKILSYSEDLKHHYQIYQLLLFHFQNKDPEKFFGLIEDNLKQVHPLFQTVFKTFLKDKEKIINALQLHYSNAKLEATNNLIKLIKRNAFGFRNFENFKKRIFIALNIKKERTKFVLSRA

SEQ ID NO: 377 - protein, 355 aa, Streptococcus pneumoniae
MTKEKNVILTARDIVVEFDVRDKVLTAIRGVSLELVEGEVLALVGESGSGKSVLTKTFTGMLEENGRIAQGSIDYRGQDLTALSSHKDWEQIRGAKIATIFQDPMTSLDPIKTIGSQITEVIVKHQGKTAKEAKELAIDYMNKVGIPDADRRFNEYPFQYSGGMRQRIVIAIALACRPDVLICDEPTTALDVTIQAQIIDLLKSLQNEYHFTTIFITHDLGVVASIADKVAVMYAGEIVEYGTVEEVFYDPRHPYTWSLLSSLPQLADDKGDLYSIPGTPPSLYTDLKGDAFALRSDYAMQIDFEQKAPQFSVSETHWAKTWLLHEDAPKVEKPAVIANLHDKIREKMGFAHLAD

SEQ ID NO: 378 - protein, 308 aa, Streptococcus pneumoniae
MSTIDKEKFQFVKRDDFASETIDAPAYSYWKSVFKQFMKKKSTVVMLGILVAIILISFIYPMFSKFDFNDVSKVNDFSVRYIKPNAEHWFGTDSNGKSLFDGVWFGARNSILISVIATVINLVIGVFVGGIWGISKSVDRVMMEVYNVISNIPPLLIVIVLTYSIGAGFWNLIFAMSVTTWIGIAFMIRVQILRYRDLEYNLASRTLGTPTLKIVAKNIMPQLVSVIVTTMTQMLPSFISYEAFLSFFGLGLPITVPSLGRLISDYSQNVTTNAYLFWIPLTTLVLVSLSLFVVGQNLADASDPRTHR

SEQ ID NO: 379 - protein, 498 aa, Streptococcus pneumoniae
MKKYIFMRVLRSLVSIFLVTTLTYTIIYTLVPRKLIFKQDPNYNKIATTADKRDNYENTVFERMGYIEYYDTKELQEKASSMDSSVTVEANATNKAIYEKYINQLGHGWTLGEFTESGQFYATREIPIFERVFHFYANLIDIDHTNKIQDPENPDLKRYLRFENDPAIGWSLVGSGTKHKYLLYFNSQFPFVHQNFVNLNLGDSYPTYANTPVLQVITQGQGQTKTAQVQFPTGKKTSSVNIYSRTYKSPSQADSREVASYGKDDPYTATESNYQYPSMIVSSAITGLIGLVLAYALAVPLGSAMARFKNTWIDSLSTGALTFLLALPTIALVYIVRLIGSSIALPDSFPILGAGDWRSYVLPAVILGLLGAPGTAIWIRRYMIDLQSQDFVRFARAKGLSEKEISNKHIFKNAMVPLVSGIPAAIIGVIGGATLTETVFAFPGMGKMLIDSVKASNNSMVVGLVFIFTCISIFSRLLGDIWMTIIDPRIKLTEKGGK

SEQ ID NO: 380 - protein, 343 aa, Streptococcus pneumoniae
MGFLLMGALFIVLPRTMVSAKRINQVLDLHSSIQNPVQVQLTDENFKGQVEFKDVTFRYAANSEAVIEHVSFKAETGQTVAFIGSTGSGKSTLVNLIPRFYDVSAGEILVDGVNVQDYDFSATAHAGQKVAIVGPTGAGKTTIVNLLMKFYEIDKGSIRIDGVDTKAMTRSEVHDAFSMVLQDTWLFEGTIRDNLIYNQIGISDERMMEASKAVGIHHFIMTLPDGYDTILDDTVTLSVRQKQLLTIARALLKDAPLLILDEATSSVDTRTEELIQKAMDRLMEGRTSFVIAHRLSTIRNADLILVMKDGNIIEQGNYEELMAQGGFYADLYNSQFTEDEAEE

SEQ ID NO: 381 - protein, 273 aa, Streptococcus pneumoniae
MILLAILFTCFSVYLELEVPTYISKITDLLGSQETNLDELWQSASMMMGMSFLAFLSVVAVGFFASRVAASYTSRLRSDIFNRVLDYSQTEIKKFSIPSLLTRTTNDITQVQMLITMGLQVVTRGSIMAIWAIGKILGHSEYWLWAVLVAVIINVLMTTVLMTLAFPKQSLIQGLTDKLNSITRESLTGIRVVRAYNAEDYQNEKFAAVNDELTRLNLFVNRLMAILNPIMMGISSGLSVAIYWIGAYVINDAAPIARLPLFSDMIVFMSYAM

SEQ ID NO: 382 - protein, 456 aa, Streptococcus pneumoniae
MNKKRTVDLIHGPILPSLLSFTFPILLSNIFQQLYNTADVLIVGRFLGQESLAAVGATTAIFDLIVGFTLGVGNGMGIVIARYYGARNFTKIKEAVAATWILGALLSILVMLLGFLGLYPLLQYLDTPAEILPQSYQYISMIVTCVGVSFAYNLFAGLLRSIGDSLAALGFLIFSALVNVVLDLYFITQLHLGVQSAGLATIISQGLSAVLCFYYIRKSVPELLPQFKHFKWDKSLYADLLEQGLAMGLMSSIVSIGSVILQFSVNTFGAVIISAQTAARRIMTFALLPMTAISASMTTFASQNLGAKRPDRIVQGLRIGSRLSISWAVFVCIFLFFASPALVSFLASSTDGYLIENGSLYLQISSTFYPILSLLLIYRNCLQGLGQKILPLVSSFIELIGKIVFVVLIIPWAGYKGVILCEPLIWVAMTVQLYFSLFRHPLIKEGKAILATKVQS

SEQ ID NO: 383 - protein, 206 aa, Streptococcus pneumoniae
MKSMRILFLLALIQISLSSCFLWKECILSFKQSTAFFIGSMVFVSGICAGVNYLYTRKQEVHSVLASKKSVKLFYSMLLLINLLGAVLVLSDNLFIKNTLQQELVDFLLPSFFFLFGLDLLIFLPLKKYVRDFLAMLDRKKTVLVTILATLLFLRNPMTIVSLLIYIGLGLFFAAYLVPNSVKKEVSFYGHIFRDLVLVIVTLIFF

SEQ ID NO: 384 - protein, 702 aa, Streptococcus pneumoniae
MKIPMIYQMENSECGLACCAMILNYFKYEISLNELREIYPSSRSGYSLLSISKVLGDFNISSHAFKASVRDLKPLSFPLICFWESSHFIILEKISKNKFYILDPAKGRQRMSISEFERHYSNIILTFKKLDSFMSRKDNKKSPVLKYFFKYRNKLGILFFVTALLYVIQSLVPIANRYIIDTNFKDDSYSSRMLFTILFIFTVSFSLMYLLRQIYVASLKYIMDKEISYDFMKHLIYLPYSFYEKRTLGDILFRANSIVYIREILSNNFIAAILDLLMIVVYAVVLFSFSKYMVIFLISLSLALSIVMYPIIKISKNLIDKNIKEKVNVQNITSEVISKNSDIKLTGEEEFWINKWDNFNTKQLIIGRKLDIHLSIVSSITNVLQIILPVLTLIVGVNIKTFEQLTLGQIVAISTVSPYFISPIISLSDNYIQLMLLKGYFLRIEDVFNTKSELIPERVSQDIKFDKKIELKDIWYKYGLFDDYVLKGINVTIKKGETVAIVGESGSGKSTLAKILLGLLEPNIGSIEVDGVEKEEIGQTLYRKIFGAVLQNSTLSYGTLRENLTFGHFVSDEELMTNLNSIGLSNVVKSLPLGLETIIAEEGNNFSGGQQQMILLARCLLSKPSVVVLDEATSSLDNLSQQITTSYLSEIGTTKILIAHRLDTIKSADKILVMHNGEIVEIGTHRELLELGGIYKQLYSNN

SEQ ID NO: 385 - protein, 103 aa, Streptococcus pneumoniae
MLNIPNVLRYDLNMLQLEYKNEQSWDSFIDNVNLIELEERIQTTIGIKQINTHNIITIAREGYSQNYLPNTSENTYNSLQVSLVGVLLLFISMVNILWAKKSK

SEQ ID NO: 386 - protein, 210 aa, Streptococcus pneumoniae
MIELKQVSKSFGERELFSNLSMTFEAGKVYALIGSSGSGKTTLMNMIGKLEPYDGTIFYRGKDLANYKSSDFFRHELGYLFQNFGLIENQSIEENLKLGLIGQKLSRSEQRLRQKQALEQVGLVYLDLDKRIFELSGGESQRVALAKIILKNPPFILADEPTASIDPATSQLIMEILLSLRDDNRLIIIATHNPAIWEMADEVFTMDHLK

SEQ ID NO: 387 - protein, 345 aa, Streptococcus pneumoniae
MKKKIRWPLYVIAALIVTFLAFVVPLPYYIEVPGGSEDIRQVLKVNDTEDKEAGAYQFVTVGVQHATLAHMIYAWLTPFTDIRSAQETTGGSSDVEFMRINQFYMQTSQNMAKYQGLKTAGKDIELKYFGVYVLNVTDNSTFKGILNISDTVTAVNDQTFDSSKDLIDYVSSQKLGDSVKVTYEEDGQTKSAEGKIITLENGKNGIGIGLIDRTEVISNVPISFSTAGIGGPSAGLMFSLAIYTQIAHPDLRNGRIVAGTGTIDRDGNVGDIGGIDKKVVASARAGAAIFFAPDNPVSEEEQKAHPDAKNNYQTALEAAKTIKTDMKIVPVKTLQDAIDYLKNNP

SEQ ID NO: 388 - protein, 308 aa, Streptococcus pneumoniae
MKSIKRFALSAMGVAMLLVLTGCVNVDKTTGQPTGFIWNTIGAPMAEAIKYFATDKGLGFGVAIIIVTIIVRLIILPLGIYQSWKATLHSEKMNALKHVLEPHQTRLKEATTQEEKLEAQQALFAAQKEHGISMFGGVGCFPILLQMPFFSAIYFAAQHTEGVAQASYLGIPLGSPSMILVACAGVLYYLQSLLSLHGVEDEMQREQIKKMIYMSPLMIVVFSLFSPASVTLYWVVGGFMMILQQFIVNYIVRPKLRKKVREELAKNPPKASAFSKPSGRKDVTPEQPTAITSKKKHKNRNAGKQRSR

SEQ ID NO: 389 - protein, 213 aa, Streptococcus pneumoniae
MIDIQGLEKKFNDRAIFSGLNLKLEKGKVYALIGKSGSGKTTLLNILGKLEKIDGGRVLYQGKDLKTIPTREYFRDQMGYLFQNFGLLENQSIKENLDLGFVGQKISKVERLERQVGALEKVNLGYLDLEQKIYTLSGGEAQRVALAKTILKNPPLILADEPTAALDPENSEEVMNLLVDLKDENRIIIIATHNPLVWNKADEIIDMRKLAHV

SEQ ID NO: 390 - protein, 680 aa, Streptococcus pneumoniae
MEEMMKRLFILISMVLVSLYMVITSVDHREEILFGNYPSVDVTGMMINQPVASREEVTEALSHLAVEHNSLIARRIVEPNEAGETRFTYATYGEGKLPEGLTISSKESAETSDLLGSYLIVSGSLDGVSLQTTLKELGYQGFVSNGEDPFSIVLLLTATPMVLLSLAIFLLTFMSLTLIYRIKSLRQAGIRLIAGESLFGVALRPVLEDVRQLICSVLVSSLLGLGILWYQGALFMATVQLVIIALLLYGLTLAGISTLLSVVYLLGLQENSLVDLLKGKLPLKRMMTLMMVGQLLAVLVVGSSATALLPHYREMQEMERASNKWSQSSDRYRLSFGWSSAFADEEGTRKDNREWQTFTEERLANTDSFYIMSNVDNFSDGAEVDLDGNRLSDYTPSGNVIYVSPRYLIEEKITVSSEFMDKMQNLSEGEFGLILPESLREQSVYYQGLFTDYLQNFSSESVEVTSQKHYLPQVRLAFTETGQERFLYNDGYKTTRQYLKDPIIVVLTPQATGTRPVAGMLWGTTANSALKLDRYGDSITALKEKGLYHKVSYLVKSQLFFAKVLNDKRVEFYSLLIGTILTLSTAILLFDSMNLLYFEQFRRELMIKRLAGMTIYELHGKYLLAQGGVLLLGLVLSSILTRDGLISALVVALFTLNALLILVRQDKKEEAGSMAVLKGK

SEQ ID NO: 391 - protein, 294 aa, Streptococcus pneumoniae
MNMIKVESLNKNIKGKAILKGISFEVAEGECVALIGPNGAGKTTLLDCLLGDKLVTSGQVSIQGLSVTSSQLDYIRGYLPQENVIVQKLKVKELIAFFQRIYPNSLSDQEIDQLLQFDQQQKEQFAEKLSGGQKRLFSFVLTLIGRPKLVFLDEPTAAMDTSTRQRFWEIVRDLKAQGVTILYSSHYIEEVEHTADRILVLNKGELIRDTTPLAMRSEGIEKHFILPLAYKEVIEQSNLVENWSQKQDALQVVTREADAFWELLVQAGCGIQEIEVNNRSLLDTIFEETQKGDN

SEQ ID NO: 392 - protein, 431 aa, Streptococcus pneumoniae
MKNSKFIDQFATFAGKLGNQIHLKTLRDAFVTVMPLYILAGLIVLLNNTVFKWIFQGDTLTRFQYWGITIANGTLSISGMIIAVMVGYFLAKNRDFENPLAASMLSLVSLIVMMPNTVSVVPDGAKDAVNISGVLSFNNTGTGAMFAGVIVAIIATELFIELSNVKALQMNLGENIPPAVSRSFSVLLPVMTVISLFGVVSALLFNITGMNLISIITIFIQEPIRHIGTSLIGVIIIYSLGNMLWLFGIHQAVIYSAILEPLLLINITENITAANNGQAIPHIINLSQIQTFALMGGSGSTLCLLIATFLVSRNAVSKNVAKLSFGPGIFNINEPVLFGYPIVYNISLAIPFITVPVLGILISYLATVTEFMSPAFIQVPWTTPVFLNAWLATAGDVRAVLVQFIIFALGVLLYIPFIKVNDKVVEQEMEG

SEQ ID NO: 393 - protein, 890 aa, Streptococcus pneumoniae
MKAMEENMADKKTVTPEEKKLVAEKHVDELVQKALVALEEMRKLDQEQVDYIVAKASVAALDAHGELALHAFEETGRGVFEDKATKNLFACEHVVNNMRHTKTVGVIEEDDVTGLTLIAEPVGVVCGITPTTNPTSTAIFKSLISLKTRNPIVFAFHPSAQESSAHAARIVRDAAIAAGAPENCVQWITQPSMEATSALMNHEGVATILATGGNAMVKAAYSCGKPALGVGAGNVPAYVEKSANIRQAAHDIVMSKSFDNGMVCASEQAVIIDKEIYDEFVAEFKSYHTYFVNKKEKALLEEFCFGVKANSKNCAGAKLNADIVGKPATWIAEQAGFTVPEGTNILAAECKEVGENEPLTREKLSPVIAVLKSESREDGITKARQMVEFNGLGHSAAIHTADEELTKEFGKAVKAIRVICNSPSTFGGIGDVYNAFLPSLTLGCGSYGRNSVGDNVSAINLLNIKKVGRRRNNMQWMKLPSKTYFERDSIQYLQKCRDVERVMIVTDHAMVELGFLDRIIEQLDLRRNKVVYQIFADVEPDPDITTVNRGTEIMRAFKPDTIIALGGGSPMDAAKVMWLFYEQPEVDFRDLVQKFMDIRKRAFKFPLLGKKTKFIAIPTTSGTGSEVTPFAVISDKANNRKYPIADYSLTPTVAIVDPALVLTVPGFVAADTGMDVLTHATEAYVSQMASDYTDGLALQAIKLVFENLESSVKNADFHSREKMHNASTIAGMAFANAFLGISHSMAHKIGAQFHTIHGRTNAILLPYVIRYNGTRPAKTATWPKYNYYRADEKYQDIARMLGLPASTPEEGVESYAKAVYELGERIGIQMNFRDQGIDEKEWKEHSRKLAFLAYEDQCSPANPRLPMVDHMQEIIEDAYYGYKERPGRRK

SEQ ID NO: 394 - protein, 99 aa, Streptococcus pneumoniae
MNPNITFLIMLVGMMALMFFMQRSQKKQAQKRMESLNKLQKGYEVITIGGLYGTVDEVDTEKGTIVLDVDGVYLTFELAAIKTVLPLKETASLEGAIEK

SEQ ID NO: 395 - protein, 605 aa, Streptococcus pneumoniae
MRIKWFSLIRIIGLLLVLLYHFFQTIFPGGFFGVDVFFTFSGFLITALLIEEFSKNNEIDLIGFFRRRFYRIVPPVVLMVLVTMPFTFLVRQDYVAGIGGQIAGVLGFMTNFYELLTGGSYESQFIPHLFVHNWSLAVEVHYYILWGLAVWFLSKQAKSNGQLKGMVFLLSAVAFLISFFSMFIGSFLVTSYSSVYFSSLTHVYPFFLGSMLATIVGVRQTTSLVKQLDKIWDLRKTLVVFGGGFGFLVLLTFFVKFTYLFAYLIGFLLASLAALAMILAARVLHEKTHHIQESKIISFLADTSYAVYLFHWPFYIIFSQLTSNLLAVLLTLICSYGFASLSFYVLEPWIAGKNTPIVQTLRPLPYIHAILAAGTGILTIIVCTVTLLAPQVGAFETDLTVNGLKQAATNIGQTKVMAERADANSLGIADGTMLIGDSVALRANTALQTALPGAQINAQVSVTTKTANEIMLNNSQNKFLPKTVVIATGVNNPENYKDDWDSIVKNLPKGHHMILVTPYEGDKTKETYAIVEKAAAYMRELAEKTPYITIADWNQVAKEHPEIWAGTDQVHFGSESSTIEAGAKLYADTIATALQTAQDKPVKSK

SEQ ID NO: 396 - protein, 119 aa, Streptococcus pneumoniae
MSIILTTIVALEHFYIFYLESIATQSDATSRVFNMEKEELAHPSVSSLFKNQGIYKALLGVFLLYVIYFSQNLEIVTIFVLFVIGAATYGSLTADKKIILKQGGSAILALISILLFKYT

SEQ ID NO: 397 - protein, 603 aa, Streptococcus pneumoniae
MAVANCAKYNIRRSKMKTVQFFWHYFKVYKFSFVVVILMIVLATFAQALFPVFSGQAVTQLANLVQAYQNGNPELVWQSLSGIMVNLGLLVLVLFISSVIYMCLMTRVIAESTNEMRKGLFGKLAQLTVSFFDRRQDGDILSHFTSDLDNILQAFNESLIQVMSNIVLYIGLILVMFSRNVTLALITIASTPLAFLMLIFIVKMARKYTNLQQKEVGKLNAYMDESISGQKAVIVQGIQEDMMAGFLEQNERVRKATFKGRMFSGILFPVMNGMSLINTAIVIFAGSAVLLNDKSIETSTALGLIVMFAQFSQQYYQPIIQVAASWGSLQLAFTGAERIQEMFDAEEEIRPEKAPTFTKLQESVEISHIVFSYLPDKPILKDVSISAPKGQMTAVVGPTGSGKTTIMNLINRFYDVDAGGIYFDGKDIRGYDLDSLRSKVGIVLQDSVLFSGTIRDNIRFGVPDASQEMVEVAAKATHIHDYIESLPDKYDTLIDDDQSIFSTGQKQLISIARTLMTDPEVLILDEATSNVDTVTESKIQHAMEVVVAGRTSFVIAHRLKTILNADQIIVLKDGEVIERGNHHELLKLGGFYSELYHNQFVFE

SEQ ID NO: 398 - protein, 250 aa, Streptococcus pneumoniae
MGTFSVRHLDLFYGDFQALKNISIQLPERQITALIGPSGCGKSTFLKTLNRMNDLVPSCHIEGQVLLDEQDIYSSKFNLNQLRKRVGMVFQQPNPFAMSIYDNVAYGPRTHGIRDKKQLDALVEKSLKGAAIWEEVKDDLKKSAMSLSGGQQQRLCIARALAVEPDILLMDEPTSALDPISTLKIEDLIQQLKKDYTIIIVTHNMQQASRISDKTAFFLTGEICEFGDTVDVFTNPKDQRTEDYISGRFG

SEQ ID NO: 399 - protein, 226 aa, Streptococcus pneumoniae
MMKEIFDRRYPVTSFFLLVTALVFLLMLVTAGGNFDRADTLFRFGAMYGPAIRLFPEQVWRLLSAIFVHIGWEHFIVNMLSLYYLGRQVEEIFGSKQFFFLYLLSGMMGNLFVFVFSPKSLAAGASTSLYGLFAAIIVLRYATRNPYIQQLGQSYLTLFVVNIIGSVLIPGISLAGHIGGAVGGAFLAVIFPVRGEKRMYNTSQRLGAVVLFVGLAILLFYKGMGL

SEQ ID NO: 400 - protein, 232 aa, Streptococcus pneumoniae
MTATKMNAQEIIQFIANAEKKTSVKVTFEGQLATAVPSSVVKLGNVLFGDWKDVAPLLEGLVENQDYVVEQDARNSAVPLLDKRAINARIEPGAIIRDQVEIGDNAVIMMGSVINIGAEIGAGTMIDMGAILGGRAIVGKNSHVGAGAVLAGVIEPASAEPVRVGDNVLIGANAVVIEGVQIGSGSVVAAGAIVTQDVPENVVVAGVPARIIKEIDAQTQQKTALEDALRTL

SEQ ID NO: 401 - protein, 361 aa, Streptococcus pneumoniae
MWGVYQLHPAPAVQVVVLAIAVTQVLHDLLLQGRDDNSLNEVANQWIATFFLSCYNKGMNQYQKKIVNGKIYSLLSGLIWGICGILGEYFFTHYQVSSGWITSMRLTLAGSLVLIWSAIQLKSQVLDIWRDKKNYLPFLAYAILGIFSVQYFFYLCVEYSNATTATILQFISPVFILFYNRLVYQKRASKSAVFYVLVAMLGVCLMATKGDLSQLSMTPLALITGLLSAMGVMFNVILPQPFAKRYGFVPTVGWGMILAGLFSNVLSPVYQLSFTLDIWSILICLIIAFFGTAFAFFISMKAVSLVSPLVVAVISASEPLSSALLSVLFLGLVVDWSLLLAIALIILPMIFLSIEEAKESR

SEQ ID NO: 402 - protein, 190 aa, Streptococcus pneumoniae
MNKLMKFISVFLTSIVLIVSAIPSVSAVYASEQVSQIETNMELQPVTSLTEEQINTLANEIQSFHPDVSQQWIKEVINRQLQGDYTIPPTYSPFRAVWQGITVNQMGALLDTAIALALGGTTAGLANLIKVKGKHAAKSAIRSAISRYLGSWFVNDVALEFAMNLLSPGTYLAQLWDKNDAIPNNGRINF

SEQ ID NO: 403 - protein, 435 aa, Streptococcus pneumoniae
MKGVNMEKQQPSKAALLSIIPGLGQIYNKQKAKGFIFLGVTIVFVLYFLALATPELSNLITLGDKPGRDNSLFMLIRGAFHLIFVIVYVLFYFSNIKDAHTIAKRINNGIPVPRTLKDMIKGIYENGFPYLLIIPSYVAMTFAIIFPVIVTLMIAFTNYDFQHLPPNKLLDWVGLTNFTNIWSLSTFRSAFGSVLSWTIIWALAASTLQIVIGIFTAIIANQPFIKGKRIFGVIFLLPWAVPAFITILTFSNMFNDSVGAINTQVLPILAKFLPFLDGALIPWKTDPTWTKIALIMMQGWLGFPYIYVLTLGILQSIPNDLYEAAYIDGANAWQKFRNITFPMILAVAAPTLISQYTFNFNNFSIMYLFNGGGPGSVGGGAGSTDILISWIYRLTTGTSPQYSMAAAVTLIISIIVISISMIAFKKLHAFDMEDV

SEQ ID NO: 404 - protein, 287 aa, Streptococcus pneumoniae
MIWRTSKMNNSIKLKRRLTQSLTYLYLIGLSIVIIYPLLITIMSAFKAGNVSAFKLDTNIDLNFDNFKGLFTETLYGTWYLNTLIIALITMAVQTSIIVLAGYAYSRYNFLARKQSLVFFLIIQMVPTMAALTAFFVMALMLNALNHNWFLIFLYVGGGIPMNAWLMKGYFDTVPMSLDESAKLDGAGHFRRFWQIVLPLVRPMVAVQALWAFMGPFGDYILSSFLLREKEYFTVAVGLQTFVNNAKNLKIAYFSAGAILIALPICILFFFLQKNFVSGLTSGGDKG

SEQ ID NO: 405 - protein, 266 aa, Streptococcus pneumoniae
MLPYPFSYFSSIWGVRKPLSKRFELNWFQLLFTSIFLISLSMVPIAIQNSSQETYPLETFIDNVYEPLTDKVVQDLSEHATIVDGTLTYTGTASQAPSVVIGPSQIKELPKDLQLHFDTNELVISKESKELTRISYRAIQTESFKSKDSLTQAISKDWYQQNRVYISLFLVLGASFLFGLNFFIVSLGASFLLYITKRSRLFSFNTFKECYHFILNCLGLPTLITLILGLFGQNMTTLITVQNILFVLYLVTIFYKTHFRDPNYHK

SEQ ID NO: 406 - protein, 313 aa, Streptococcus pneumoniae
MKQTKRIKRWRYYLRRFAYQIKILRVLQSISREKYDEKISASLVYGFLSAVAVNFFFQPGHVYSSGATGLAQIISALSNHWFGFHIPISLSFYAINFPLMVLAWYQIGHKFTVFTFITVSMSSFFIQFVPVATLTEDPIINSLFGGVVMGLGIGFALRNNISSGGTDIVSLTIRKKTGKNVGSISFLVNGTIMLIAGLTFGWKYALYSMITIFVSSRVTDAVFTKQKRMQAMIVTNHPEKVIEKIHKKLHRGATMIHDAEGTYNHERKAVLITVITRAEFNEFKQIMTQVDPSSFVSVSENVHILGRFVEIDN

SEQ ID NO: 407 - protein, 76 aa, Streptococcus pneumoniae
MKRVILLAVIQAVVLFFIIGALAYAFKGDFFYNYLAVVFAPIAGVLRFGTAYITEIVLPRKAAEIAEKRKAGKNSK

SEQ ID NO: 408 - protein, 213 aa, Streptococcus pneumoniae
MKLLKNLGWILLALLSFLFIYGFIQGLATASLALGASPYAVTLLYVALAGVYVYGIYKWYQKAPVHIEKSGFNRFIWLPVLVWFLSLVVQFFLPDDPSVNQQIATDLTLSQPLFSFFAVVIFAPLTEEIVFRGMLARYLFPKQDNSKRTLIFLLVSSLLFALIHFPGDVQQFFVYFSLGFSLGLAYISRKGLVYSISLHALNNLVGFLMILML

SEQ ID NO: 409 - protein, 226 aa, Streptococcus pneumoniae
MGMFVGMFKARVESHEIILDVKALMPWISAICLLIGFISMFLTFNFLKKSRKFHSLYQEEMDDDLNETYYVQMYRNLEFGTIAFNITGVAIPLAIFISLSEVIILHTNPQTFFLSFLLFVVFLVAQKSLFKTIAIVRQFDLEFFATPKDVLNYINSYDEGERQANLEQSFRILFQLHQYVLPALYIFLIIISFLTGEIQLLAFLLVGAIHVYINVMQLPMVKRYFK

SEQ ID NO: 410 - protein, 621 aa, Streptococcus pneumoniae
MKKTTILSLTTAAVILAAYVPNEPILADTPSSEVIKETKVGSIIQQNNIKYKVLTVEGNIGTVQVGNGVTPVEFEAGQDGKPFTIPTKITVGDKVFTVTEVASQAFSYYPDETGRIVYYPSSITIPSSIKKIQKKGFHGSKAKTIIFDKGSQLEKIEDRAFDFSELEEIELPASLEYIGTSAFSFSQKLKKLTFSSSSKLELISHEAFANLSNLEKLTLPKSVKTLGSNLFRLTTSLKHVDVEEGNESFASVDGVLFSKDKTQLIYYPSQKNDESYKTPKETKELASYSFNKNSYLKKLELNEGLEKIGTFAFADAIKLEEISLPNSLETIERLAFYGNLELKELILPDNVKNFGKHVMNGLPKLKSLTIGNNINSLPSFFLSGVLDSLKEIHIKNKSTEFSVKKDTFAIPETVKFYVTSEHIKDVLKSNLSTSNDIIVEKVDNIKQETDVAKPKKNSNQGVVGWVKDKGLWYYLNESGSMATGWVKDKGLWYYLNESGSMATGWVKDKGLWYYLNESGSMATGWVKDKGLWYYLNESGSMATGWVKDKGLWYYLNESGSMATGWVKDKGLWYYLNESGSMATGWVTVSGKWYYTYNSGDLLVNTTTPDGYRVNANGEWVG

SEQ ID NO: 411 - protein, 383 aa, Streptococcus pneumoniae
MAIFYVPAVNLIGKGVVNEVGPYIKELGYKKALLVTDKYIEGSDILPKTLKPLDTEGIEYVIFSDVEPNPTCKNVTDGVAALQEHGCDFIISLGGGSPQDAASCISIMATNGGKPQDYEGLHKSAKKGLPVVAINTTAGTSAEITINYVITDEERKVKMVMVDKNSLALISVNDPELMLSKPKGLTAATGMDALTHAVEALVTPGAYDVTKKLSIGAIELIKEYLPRAVENGHDIEAREGMVNAIFLGGMSFNNAGLGYVHSMAHQLGAVYNLPHGVCCAMLLPVIERENAKRVPEAFRNVAKALGLHVEGKSDQECADYAIAEIEKLSETVGIPKKLTELGIEEKDFDFEYLSKNALIDACAPGNPFMPTLEETIAFYKELF

SEQ ID NO: 412 - protein, 257 aa, Streptococcus pneumoniae
MIKDERVLELIEIIKKKKRIAVKELAEITFSSTSTLRRDLIFLENQGLIKRKHGYVTLSSMNTIELSHQIREGESTRQKRLIASLAKDFIRSGMCIYLDSSTTVYELCPYLSELDNLIIFTNGLHTAQTLSETVKDSSKIFITSGEVKHQSCSVVNYDKENSLLDHFNIDLAFCSARGIDDQYVYEASLSQAISKKNIIDKAHETILLIDSSKFYKTGFFKINPLSKYTTFISDTVPDQKLLDAVELFDGEWVSDIQ

SEQ ID NO: 413 - protein, 268 aa, Streptococcus pneumoniae
MLSLLSYDFIQRAFLAVIAMSLFSPVLGTFLILRRQSLMSDTLSHVSLSGVAFGLVLGISPTVSTIAIVLIAAVFLEYLRTVYKSFMEIGTAILMSTGLAVSLIVMSKGKSSSSMSLDQYLFGSIVTISEEQVISLFVIAAVVLILTFLFLRPMYILTFDEDTAFVDGLPVRTMSILFNMVTGVAIALMIPAAGALLVSTIMVLPASIALRLGKNFKSVMLLASAIGFLGMVAGLYISYYAETPASASITIIFVTVFILISLVRRFIK

SEQ ID NO: 414 - protein, 234 aa, Streptococcus pneumoniae
MRYITVEDLSFYYDKEPVLEHINYCVDSGEFVTLTGENGAAKTTLIKASLGILQPRIGKVAISKTNTQGKKLRIAYLPQQIASFNAGFPSTVYEFVKSGRYPRKGWFRRLNAHDEEHIKASLDSVGMWEHRDKRLGSLSGGQKQRAVIARMFASDPDVFILDEPTTGMDAGSKNEFYELMHHSAHHHGKAVLMITHDPEEVKDYADRNIHLVRNQDSPWRCFNVHENGQEVGHA

SEQ ID NO: 415 - protein, 516 aa, Streptococcus pneumoniae
MSNKPIADMIETIEHFAQTQPSYPVYNVLGQEHTYGDLKADSDSLAAVIDQLGLPEKSPVVVFGGQEYEMLATFVALTKSGHAYIPIDSHSALERVSAILEVAEPSLIIAISAFPLEQVSTPMINLAQVQEAFAQGNNYEITHPVKGDDNYYIIFTSGTTGKPKGVQISHDNLLSFTNWMITDKEFATPSRPQMLAQPPYSFDLSVMYWAPTLALGGTLFTLPSVITQDFKQLFAAIFSLPIAIWTSTPSFADMAMLSEYFNSEKMPGITHFYFDGEELTVKTAQKLRERFPNARIINAYGPTEATVALSAVAVTDEMLATLKRLPIGYTKADSPTFIIDEEGNKLPNGEQGEIIVSGPAVSKGYMNNPEKTAEAFFEFEDLPAYHTGDVGTMTDEGLLLYGGRMDFQIKFNGYRIELEDVSQNLNKSRFIESAVAVPRYNKDHKVQNLLAYVILKDGVREQFERDIDITKAIKEDLTDIMMSYMMPSKFLYRDSLPLTPNGKIDIKGLINEVNKR

SEQ ID NO: 416 - protein, 131 aa, Streptococcus pneumoniae
MMSLVHNIIEDGDTESLIRKYLHSGVIINGQRYKTLVGTPQGGNLSPLLSNIMLNELDKELEKRGLRFVRYADDCVITVGSEAASKRVMYSVSRFIEKRLGLKVNMTKRVEISRFWVLEIIRWLEKPSTSR

SEQ ID NO: 417 - protein, 137 aa, Streptococcus pneumoniae
MSKLLDKILSRENMLEAYNQVKSNKGSAGIDGMTIEEMDNYLRQNWRLTKELIKQRKYKPQPVLRVEIPKPDGGIRQLGIPTVMDRMIQQAIVQVMSPICEPHFSDTSYGFRPNRSCEKAIMKLLEYLNDGYEWIVD

SEQ ID NO: 418 - protein, 164 aa, Streptococcus pneumoniae
MRQLKRVGVFLLLPFFVLIDAHISQLLGSFFPHVHLASHFLFLFLLFETIEVSEYLYLVYCFVIGLVYDVYFFHLIGITTLLFILLGAFLHKLNSVILLNRWTRMLAMIVLTFLFEMGSYLLAFMVGLTVDSMSIFIVYSLVPTMILNFLWITVFQFIFEKYYL

SEQ ID NO: 419 - protein, 427 aa, Streptococcus pneumoniae
MTKVVFEEKYYPAVKEMVYRTRLANGLTVALLPKKEFKEVYGSVTVQFGSVDTFVTEVDGDVKQYPGGIAHFLEHKLFEREDSSDLMSAFTSLGADSNAFTSFTKTNYLFSATDYFLENLDLLDELVTSAHFTEASILTEQDIIQQEREMYQDDPDSCLFFSTLANLYPGTPLATDIVGSEESISQINLTNLQENFTKFYKPVNMSLFLVGNFDVERVQDYFESKELKDSDFQEVAREKLFLQPVKPTDSMRMEVSSPKLAIGVRGKREVSEADCYRHHILLKLLFAMMFGWTSDRFQKCYESGKIDASLSLEVEITSRFHFVMLTMDTKEPVALSHQFRKAIRNFTKDLDITEEHLDIIKREMFGEFFSSMNSLEFIATQYDAFENGEIIFDLPKILQEITLEDVLDAGHHLIDDGDIVDFTIFPS

SEQ ID NO: 420 - protein, 540 aa, Streptococcus pneumoniae
MLTVSDVSLRFSDRKLFDDVNIKFTEGNTYGLIGANGAGKSTFLKILAGDIEPTTGHISLGPDERLSVLRQNHFDYEDERAIDVVIMGNEKLYSIMKEKDAIYMKEDFSDEDGVRAAELEGEFAELGGWEAESEASQLLQNLNIPEELHYQNMSELANGEKVKVLLAKALFGKPDVLLLDEPTNGLDIQSITWLEDFLIDFDNTVIVVSHDRHFLNKVCTHMADLDFGKIKLYVGNYDFWKESSELAAKLLADRNAKAEEKIKQLQEFVARFSANASKSRQATSRKKMLDKIELEEIVPSSRKYPFINFKAEREIGNDLLTVENLTVKIDGETILDNISFILRPDDKTALIGQNDIQTTALIRAIMGDIDYEGTVKWGVTTSQSYLPKDNSADFAGGESILDWLRQFASKEEDDNTFLRGFLGRMLFSGDEVNKPVNVLSGGEKVRVMLSKLMLLKSNVLVLDDPTNHLDLESISSLNDGLKNFKESIIFASHDHEFIQTLANHIIVLSKNGVIDRIDETYDEFLENAEVQAKVKELWKD

SEQ ID NO: 421 - protein, 850 aa, Streptococcus pneumoniae
MKSFLKTYRTYFISFIIPVVIMSGVYLSQSIYWNSDNSPLLGDGFHQYVIFDVALRNILHGNSNLFYTFTSGLGLNFYALSSYYLGSFLAPLVYFFDLTNMPDAIYLTTLLKFGLIGLSTFFSLNKLFQSIPQILKLALSTSYALMSFTVSQLEIKTWLDVFILIPLIITGLHLLITEKKLLLYFTSLSILFIQNYYFGYMTVLFLIFWYLCQISWDFKTRKSSVLDFIVISFLAGMASLIMTLPTLFDLQTHGEKLTEVTKFQTESSWYLDLFAKQFIGSFDTTKYGAIPMIFVGLFPFILTILFFTLKSIKFHVKLIYVIFFAFLIASFYIEALDLFWQGMHTPNMFLHRYAWIFSTLLIYTAAEVLKRLKELKVWNFLVSLFLVVAGFLATIYLKSHYSFLTDLNILLTLEFLVVYSLLLLAVIKKFISVNLFAILISLFILVEMSLNASSQMDGIAKEWGFASRSAYSRDIPAMESFSTYIGNQFTRTEKLQTQTGNDSMKFNYNGISQFSSVRNRSSSSTLDKLGFKSSGTNLNLRYANNSILADSLFGIQYNISDSPIDKYGFKDIYQKDNLTLYENQYSLPIAVASQSVYNDVKFNEHTLDNQASFLNQLANVNFDYFSPIPYEKTEKIENTNDLISVTSSSNEDAAIQYQIEVPENSQVYLSFINLHFSNDKQKKVDILVNGEKKTFTTDNVFSFFNLGYTKEKKTFNINVSFPGNSQVSFESPTFYRLDTKTFTEAIQKIKEQPVTVSTSKNKVFATYDVQQDTSIFFTIPYDKGWSAYQDGKKIEIKQAQTGFMKVDIPKGKGTITLSFIPNGFITGAICSFTSLLLFGIYNHRRKSSKA

SEQ ID NO: 422 - protein, 250 aa, Streptococcus pneumoniae
MKVLILEDVIEHQVRLERILDEISKESNIPISYKTTGKVREFEEYIENDEVNQLYFLDIDIHGIEKKGFEVAQLIRHYNPYAIIVFITSRSEFATLTYKYQVSALDFVDKDINDEMFKKRIEQNIFYTKSMLLENEDVVDYFDYNYKGNDLKIPYHDILYIETTGVSHKLRIIGKNFAKEFYGTMTDIQEKDKHTQRFYSPHKSFLVNIGNIREIDRKNLEIVFYEDHRCPISRLKIRKLKDILEKKSQK

SEQ ID NO: 423 - protein, 441 aa, Streptococcus pneumoniae
MDLLGFGTVIVHFLIISHSYRLICKGRINRKELYVFGAYTLLTEIVLEFSFYLLYLDKIGIERFLFPLGLYSYFRWMKQYERDRGLFLSLLLSLLYESTHNFLSVIFSSITGDNFVLQYHFPFFFVVTVLTYFVTLKIIYYFHLELAYFDKDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKREFE

SEQ ID NO: 424 - protein, 122 aa, Streptococcus pneumoniae
MSKNIVQLNNSFIQNEYQRRRYLMKERQKRNRFMGGVLILIMLLFILPTFNLAQSYQQLLQRRQQLADLQTQYQTLSDEKDKETAFATKLKDEDYAAKYTRAKYYYSKSREKVYTIPDLLQR

SEQ ID NO: 425 - protein, 420 aa, Streptococcus pneumoniae
MEEVEVAEVKNARVSLTGEKTKPMKLAEVTSINVNRTKTEMEEFNRVLGGGVVPGSLVLIGGDPGIGKSTLLLQVSTQLSQVGTVLYVSGEESAQQIKLRAERLGDIDSEFYLYAETNMQSVRAEVERIQPDFLIIDSIQTIMSPEISGVQGSVSQVREVTAELMQLAKTNNIAIFIVGHVTKEGTLAGPRMLEHMVDTVLYFEGERHHTFRILRAVKNRFGSTNEIGIFEMQSGGLVEVLNPSQVFLEERLDGATGSSIVVTMEGTRPILAEVQALVTPTMFGNAKRTTTGLDFNRASLIMAVLEKRAGLLLQNQDAYLKSAGGVKLDEPAIDLAVAVAIASSYKDKPTNPQECFVGELGLTGEIRRVNRIEQRINEAAKLGFTKIYVPKNSLTGITLPKEIQVIGVTTIQEVLKKVFA

SEQ ID NO: 426 - protein, 207 aa, Streptococcus pneumoniae
MPKKVLILSLLGGMFLSGWLSSFANTYIHDLLGVLFPDSPFLNAFESAIAAPLVEEPLKLLSLVFVLALIPVRKLKSLFLLGIASGLGFQMIKDIGYIRTDLPEGFDFTISRILERIISGIASHWTFSGLAVVGVYLLYRAYKGQKVGKKQGLIFLGLALGTHFLFNSPFVELETELPLAIPVVTAIALYGFYHAYCFVEKHNELMT

SEQ ID NO: 427 - protein, 717 aa, Streptococcus pneumoniae
MKFGKRHYRPQVDQMDCGVASLAMVFGYYGSYYFLAHLRELAKTTMDGTTALGLVKVAEEIGFETRAIKADMTLFDLPDLTFPFVAHVLKEGKLLHYYVVTGQDKDSIHIADPDPGVKLTKLPRERFEEEWTGVTLFMAPSPDYKPHKEQKNGLLSFIPILVKQRGLIANIVLATLLVTVINIVGSYYLQSIIDTYVPDQMRSTLGIISIGLVIVYIFQQILSYAQEYLLLVLGQRLSIDVILSYIKHVFHLPMSFFATRRTGEIVSRFTDANSIIDALASTILSIFLDVSTVVIISLVLFSQNTNLFFMTLLALPIYTVIIFAFMKPFEKMNRDTMEANAVLSSSIIEDINGIETIKSLTSESQRYQKIDKEFVDYLKKSFTYSRAESQQKALKKVAHLLLNVGILWMGAVLVMDGKMSLGQLITYNTLLVYFTNPLENIINLQTKLQTAQVANNRLNEVYLVASEFEEKKTVEDLSLMKGDMTFKQVHYKYGYGRDVLSDINLTVPQGSKVAFVGISGSGKTTLAKMMVNFYDPSQGEISLGSVNLNQIDKKALRQYINYLSQQPYVFNGTILENLLLGAKEGTTQEDILRAVELAEIREDIERMPLNYQTELTSDGAGISGGQRQRIALARALLTDAPVLILDEATSSLDILTEKRIVDNLIALDKTLIFIAHRLTIAERTEKVVVLDQGKIVEEGKHADLLAQGGFYAHLVNS

SEQ ID NO: 428 - protein, 319 aa, Streptococcus pneumoniae
MDIKIKREEIMKKFSKTLRDNWIFLLMVLPGALWLILFFYIPVFGNVVAFKDYHMTSNGFIDSIINSKWVGLDNFRFLFSSRDAFIITRNTVLYNLGFIFLGLVVSVGIAIILSELRSKRMVKIFQTSMLFPYFLSWVIISFFTDAFLNIDKGVFNHLLESLGLKEVNFYADLGIWPYLLLFLGIWKGFGYSSVMYYATIMGIDPTYYEAATVDGASKWQRIRNVTIPQLTPLVTVLTILAVGNIFRADFGLFYQIPHNAGQLYNVTNVLDVYVFNGLTQTADIGMAAAAGLYQSVVGLILVILSNLLARRVDPNSALF

SEQ ID NO: 429 - protein, 388 aa, Streptococcus pneumoniae
MKKQSLFFVPGIILIGVSLRTPFTVLPIILGNISQGLEVEVSSLGVLTSLPLLMFTLFSPFSTQLAQKIGLEHLFTYSLFFLTIGSLIRLINLPLLYLGTLMVGASVAVINVLLPSLIQANQPKKIGFLTTLYVTSMGIATALASYLAVPITQASSWKGLILLLTLLCLATFLVWLPNHRYNHRLAPQTKQKSQIKVMRNKQVWAIIIFSGFQSLIFYTVMTWLPTMSIHAGLSSHEAGLLTSILSLISIPFSMTIPSLTTSLSTRNRQLMLTLVSLAGVVGISMLFFPINNFIYWLAIHLLIGTATSALFPYLMVNFSLKTSAPEKTAQLSGLSQTGGYILAAFGPTLFGYSFDLFHSWVPSVAALLLIDILMTVALFTVDRADKIL

SEQ ID NO: 430 - protein, 150 aa, Streptococcus pneumoniae
MDFLFAAGAFGLVIANNASISGAEGGCQAEVGSASAMSAAALTLAAGGTPYQASQAIAFVIKNMLGLICDPVAGLVEVPCVKRNAMGASFAFIAADMALAGIESKIPVDEVIDAMYQVGASMPTAFRETAEGGLATTPTGRRLQKEIFGE

SEQ ID NO: 431 - DNA, 663 bp, Streptococcus pneumoniae
ggaagtagttttatgaatatagcagtaattggtttggggcatgttgggctggcctacgcgttactatttgcatctaaatataaagttgttgcatatgatatagattctgtaaaaataaataatttaaaaaagggcattcttccatctaaaaatgaagagcttatgaagtttttttgcgagaataacttaaatattactttttttgatacattttctgaaattaaaaataatattgattattatattattgcgcttccgacagattatgatgagaaaattggtagttttaatacatatgaaatcgaacaaacggtatcgaagattctgagggtaaaacctaatggaaagattattttaaagtcaacagttccgatcggcttttcaaacaaattaaaaaggctgtttgatacaaaaaatatcatttttgtccctgaatttttgagagaaggttgttctatatatgataatttatatccaagtcgcatagttgttggagatgagacagttgaaggaagaaaaattgcagagttgttcctttcgattagtactcatagtactgccaatattaaaaatgttatgttagtttctcctactgaagcagaagcaattaagcttttttctaacacattcttagctctccgtgttgcttttttaatgaactag

SEQ ID NO: 432 - DNA, 708 bp, Streptococcus pneumoniae
aaaatggttctaagaggagttcctatgtctcaaattgatctacaaaaattaactaagaaaaaccaagagtttgtccacattgctacccaacaattcatcaaagatgggaaaacagacgctgaaatccagactatttttgaggaagtcattccccaaatccttgaggagcaatctaaaggtacaactgcccgttccctatacggcgcaccaactcattgggctcatagcttcactgtcaaagagcagtacgaaaaagagcatccaaaagaaaatgatgacccaaaactgatgattatggactcagctcttttcatcactagcctctttgcccttgtcagcgccctcacaaccttctttgcggcagaccaagctttcggctatggattgattactcttctattagttggactggttggtggatttgccttctacttgatgtactactttgtttaccaatactatggaccagatatggatcgcagtcaacgtccacctttctggaaatctgtactagttatcctagcttctatgttcctttggttgcttgtcttctttgcaacaagcttcctaccagctagccttaacccagtactggatccattgccactagctattattggagcagccctcctagcccttcgcttctatctcaagaaacgcttgaatatccgtagtgcaagtgcaggaccaacacgctatcaagaataa

SEQ ID NO: 433 - DNA, 960 bp, Streptococcus pneumoniae
gaaaggataagggatatgaaacaagtttttctctctacaacaactgaatttaaagagatcgatacgcttgaaccgggtacttggatcaatctcgtcaatccgactcaaaatgaatcactcgaaatcgccaacaccttcgatattgatattgctgaccttcgagcaccgctcgatgcggaagaaatgtctcgtattaccattgaagacgagtataccctgattatcgtagacgtgccggtcacggaggaaagaaataaccgcacctactacgtaaccatcccgcttggtattatcatcactgaggaaaccattatcactacgtgtttggaaccactacctgtccttgatgtctttatcaaccgtcgattgcgtaatttctataccttcatgcgttcacgttttatctttcaaattctttatcgcaatgcagagctttacctaacagcccttcgttcaatcgaccgcaagagtgaacaaatcgaaagtcaactgcatcaatcaactcgtaatgaagaattgattgagctcatggaattggaaaaaactatcgtctatttcaaggcctccctcaaaacaaatgagcgcgtgattaagaaattgaccagttcaaccagcaatatcaagaaataccttgaggacgaagacctgcttgaagacaccctgattgaaacccaacaggccatcgagatggcagatatttatggaaacgtcttgcattctatgacagagacctttgcctctatcatttctaacaaccagaacaacatcatgaaaaccttggcccttgtgaccatcgtcatgtccatcccaaccatggtcttttctgcctacgggatgaactttaaggataatgaaatccccctaaacggagagccaaatgccttctggttaatcgtctttatcgcctttgctatgagtgtctcgctcactctctatctcatccataaaaaatggttctaa

SEQ ID NO: 434 - DNA, 330 bp, Streptococcus pneumoniae
atagacgaaaaggagaaaaagatggcaaacaaaaaaatccgtatccgtttgaaagcttacgaacaccgtacgcttgacacagcggctgcaaaaatcgtagaatcagctactcgtacaggtgcacaagttgcgggtccaatcccacttccaactgaacgtagcctctacacaatcattcgtgcgactcacaaatacaaagactctcgcgaacaatttgaaatgcgtacacacaaacgtttgatcgatatcgttaacccaactcaaaaaacagttgatgccttgatgaaattggatcttccaagtggtgtaaacgtagaaatcaaactttaa

SEQ ID NO: 435 - DNA, 645 bp, Streptococcus pneumoniae
aaaaggaactattttctcatgacaaaaggaatcttagggaaaaaagtgggaatgactcaaatcttcactgaagctggcgaattgatccctgtaacagttattgaagcaactccaaacgttgttcttcaagttaaaactgttgaaacagacggatacaacgctatccaagttggtttcgatgacaaacgcgaagtattgagcaacaaacctgctaaaggacatgtagcgaaagctaacacggctcctaagcgcttcattcgtgaattcaaaaacgttgaaggcttggaagttggtgctgaaattacagttgaaacattcgcagctggagacgttgttgacgtaacgggtacttctaaaggtaaaggtttccaaggtgttatcaaacgccacggacaatcacgtggaccaatggctcacggttctcgttaccaccgtcgtccaggttctatggggcctgttgcacctaaccgcgtattcaaaggtaaaaaccttgcaggacgtatgggtggcgaccgcgtaacaattcaaaaccttgaagttgtacaagttgttccagaaaagaacgttatccttatcaaaggtaacgtaccaggtgctaagaaatctcttatcactatcaaatcagcagttaaagctggtaaataa

SEQ ID NO: 436 - DNA, 645 bp, Streptococcus pneumoniae
agaaaggggaaatcagtcacaatggcaaacgtaacattatttgaccaaactggtaaagaagctggccaagttgttcttagcgatgcagtatttggtatcgaaccaaatgaatcagttgtgtttgatgtaatcatcagccaacgcgcaagccttcgtcaaggaacacacgctgttaaaaaccgctctgcagtatcaggtggtggacgcaaaccatggcgtcaaaaaggaactggacgtgctcgtcaaggttctatccgctcaccacaatggcgtggtggtggtgttgtcttcggaccaactccacgttcatacggctacaaacttccacaaaaagttcgtcgcctagctcttaaatcagtttactctgaaaaagttgctgaaaacaaattcgtagctgtagacgctctttcatttacagctccaaaaactgctgaatttgcaaaagttcttgcagcattgagcatcgattctaaagttcttgttatccttgaagaaggaaatgaattcgcagctctttcagctcgtaaccttccaaacgtgaaagttgcaactgctacaactgcaagtgttcttgacatcgcaaatagcgacaaacttcttgtcacacaagcagctatctctaaaatcgaggaggttcttgcataa

SEQ ID NO: 437 - DNA, 318 bp, Streptococcus pneumoniae
aatcgaggaggttcttgcataatgaatttgtatgatgttatcaaaaaacctgtcatcactgaaagctcaatggctcaacttgaagcaggaaaatatgtatttgaagttgacactcgtgcacacaaacttttgatcaagcaagctgttgaagctgctttcgaaggtgttaaagttgccaatgttaacacaatcaacgtaaaaccaaaagctaaacgtgttggacgttacactggttttactaacaaaactaaaaaagctatcatcacacttacagctgattctaaagcaatcgagttgtttgctgctgaagctgaataa

SEQ ID NO: 438 - DNA, 846 bp, Streptococcus pneumoniae
ggaggaaatatcgtgggaattcgtgtttataaaccaacaacaaacggtcgccgtaatatgacttctttggatttcgctgaaatcacaacaagcactcctgaaaaatcattgcttgttgcattgaagagcaaggctggtcgtaacaacaacggtcgtatcacagttcgtcaccaaggtggtggacacaaacgtttctaccgtttggttgacttcaaacgtaataaagacaacgttgaagcagttgttaaaacaatcgagtacgatccaaaccgttctgcaaacatcgctcttgtacactacactgacggtgtgaaagcatacatcatcgctccaaaaggtcttgaagtaggtcaacgtatcgtttcaggtccagaagcagatatcaaagtcggaaacgctcttccacttgctaacatcccagttggtactttgattcacaacatcgagttgaaaccaggtcgtggtggtgaattggtacgtgctgctggtgcatctgctcaagtattgggttctgaaggtaaatatgttcttgttcgtcttcaatcaggtgaagttcgtatgattcttggaacttgccgtgctacagttggtgttgtcggaaacgaacaacatggacttgtaaaccttggtaaagcaggacgtagccgttggaaaggtatccgcccaacagttcgtggttctgtaatgaaccctaacgatcacccacacggtggtggtgaaggtaaagcaccagttggtcgtaaagcaccatctactccatggggcaaacctgctcttggtcttaaaactcgtaacaagaaagcgaaatctgacaaacttatcgttcgtcgtcgcaacgagaaataa

SEQ ID NO: 439 - DNA, 366 bp, Streptococcus pneumoniae
gcaactagtaaatccgccagctcggtagcgctccataggagtgcaagccgctgtggtacaacatttaaaggagaaaatataaaaatgggacgcagtcttaaaaaaggacctttcgtcgatgagcatttgatgaaaaaagttgaagctcaagctaacgacgaaaagaaaaaagttattaaaacttggtcacgtcgttcaacgatcttcccaagtttcattggttacactattgcagtttatgacggacgtaaacacgtacctgtttacatccaagaagacatggtaggccacaaacttggtgaatttgcaccaactcgtacttacaaaggtcacgctgcagacgacaagaaaacacgtagaaaataa

SEQ ID NO: 440 - DNA, 345 bp, Streptococcus pneumoniae
atggcagaaattacttcagctaaagcaatggctcgtacagtacgtgtttcacctcgtaaatcacgtcttgttcttgataacatccgtggtaaaagcgtagccgatgcaatcgcaatcttgacattcactccaaacaaagctgctgaaatcatcttgaaagttttgaactcagctgtagctaacgctgaaaacaactttggtttggataaagctaacttggtagtatctgaagcattcgcaaacgaaggaccaactatgaaacgtttccgtccacgtgcgaaaggttcagcttcaccaatcaacaaacgtacagctcacatcactgtagctgttgcagaaaaataa

SEQ ID NO: 441 - DNA, 666 bp, Streptococcus pneumoniae
ggaggtaaaatcgtgggtcaaaaagtacatccaattggtatgcgtgtcggcatcatccgtgattgggatgccaaatggtatgctgaaaaagaatacgcggattaccttcatgaagatcttgcaatccgtaaattcgttcaaaaagaacttgctgacgcagcagtttcaactattgaaatcgaacgcgcagtaaacaaagttaacgtttcacttcacactgctaaaccaggtatggttatcggtaaaggtggtgctaacgttgatgcactccgtgcaaaacttaacaaattgactggaaaacaagtacacatcaacatcatcgaaatcaaacaacctgatttggatgctcaccttgtaggtgaaggaattgctcgtcaattggagcaacgtgttgctttccgtcgtgcacaaaaacaagcaatccaacgtgcaatgcgtgctggagctaaaggaatcaaaactcaagtatcaggtcgtttgaacggtgcagatatcgcccgtgctgaaggatactctgaaggaactgttccgcttcacacacttcgtgcagatatcgattacgcttgggaagaagcagatactacatacggtaaacttggtgttaaagtatggatctaccgtggtgaagttcttccagctcgtaaaaacactaaaggaggtaaataa

SEQ ID NO: 442 - DNA, 384 bp, Streptococcus pneumoniae
aaggagaaaactgaaatgattcaaacagaaactcgtttgaaagtcgcagacaacagcggtgctcgcgaaatcttgactatcaaagttcttggtggttcaggacgtaaatttgcaaacatcggtgatgttatcgtggcatctgtaaaacaagctactcctggtggtgcggttaaaaaaggtgacgttgttaaagcagttatcgttcgtactaaatcaggtgctcgtcgtgctgatggttcatacatcaaatttgacgaaaacgcagcagttatcatccgtgaagacaaaactcctcgcggaacacgtatctttggcccagttgcacgtgaattgcgtgaaggtggcttcatgaagatcgtgtcacttgctccagaagtactttaa

SEQ ID NO: 443 - DNA, 327 bp, Streptococcus pneumoniae
gaaaaatcaaggagaaacctaatgtttgtaaaaaaaggcgacaaagttcgcgtaatcgctggtaaagataagggaacagaagctgttgtccttactgcccttccaaaagtaaacaaagttatcgttgaaggtgttaacattgttaagaaacaccaacgtccaactaacgagcttcctcaaggtggtatcatcgagaaagaagcagctatccacgtatcaaacgttcaagttttggacaaaaatggtgtagctggtcgtgttggatacaaatttgtagacggtaaaaaagttcgctacaacaaaaaatcaggcgaagtgcttgattaa

SEQ ID NO: 444 - DNA, 570 bp, Streptococcus pneumoniae
ttaatcacgaaggaaaggagaagtataatggcaaatcgtttaaaagaaaaatatcttaatgaagtagttcctgctttgacagaacaattcaactactcatcagtgatggctgtgcctaaagtagataagattgttttgaacatgggtgttggtgaagctgtatcaaacgctaaaagccttgaaaaagctgctgaagaattggcacttatctcaggtcaaaaaccacttatcactaaagctaaaaaatcaatcgccggcttccgtcttcgtgaaggtgttgcgatcggtgcaaaagttacccttcgtggtgaacgtatgtacgaattcttggataaattggtatcagtttcacttccacgtgtacgtgacttccacggtgtcccaacaaaatcatttgatggacgcgggaactacacacttggtgtgaaagaacaattaatcttcccagaaatcaacttcgatgacgttgacaaaactcgtggtcttgacatcgttatcgtaacaactgctaacactgacgaagagtcacgtgcattgcttacaggccttggaatgccttttgcaaaataa

SEQ ID NO: 445 - DNA, 414 bp, Streptococcus pneumoniae
gaggagaaaaacaaaatggttatgactgacccaatcgcagacttcctaactcgtattcgtaatgctaaccaagctaaacacgaagtacttgaagtacctgcatcaaacatcaaaaaagggattgctgaaatccttaaacgcgaaggttttgtaaaaaacgttgaaatcattgaagatgacaaacaaggcgtcatccgtgtatttcttaaatacggaccaaatggtgagaaagttatcactaacttgaaacgtgtttctaaaccaggacttcgtgtctacaaaaaacgtgaagaccttccaaaagttcttaacggacttggaattgccatcctttcaacttctgaaggtttgcttactgataaagaagcacgccaaaagaatgttggtggtgaggttatcgcttacgtttggtaa

SEQ ID NO: 446 - DNA, 552 bp, Streptococcus pneumoniae
caggagaaaataaacatgtcacgtattggtaataaagttatcgtgttgcctgctggtgttgaactcgctaacaatgacaacgttgtaactgtaaaaggatctaaaggagaacttactcgtgagttctcaaaagatattgaaatccgtgtggaaggtactgaaataactcttcaccgtccaaacgattcaaaagaaatgaaaactatccacggaactactcgtgcccttttgaacaacatggttgttggtgtatcagaaggattcaagaaagaacttgaaatgcgtggggttggttaccgtgcacagcttcaaggatctaaacttgttttggctgttggtaaatctcatccagacgaagttgaagctccagaaggaattacttttgaacttccaaacccaacaacaatcgttgttagcggaatttcaaaagaagtagttggtcaaacagctgcttacgtacgtagccttcgttcaccagaaccatataaaggtaaaggtatccgttacgttggtgaattcgttcgccgtaaagaaggtaaaacaggtaaataa

SEQ ID NO: 447 - DNA, 426 bp, Streptococcus pneumoniae
tcatcaaccaccaacctattttccaactttgtgcatagcacacgatttaaaactaaagaggtgaaaactgtgatttcaaaaccagataaaaacaaactccgccaaaaacgccaccgtcgcgttcgcggaaaactctctggaactgctgatcgcccacgtttgaacgtattccgttctaatacaggcatctacgctcaagtgattgatgacgtagcgggtgtaacgctcgcaagtgcttcaactcttgataaagaagtttcaaaaggaactaaaactgaacaagccgttgctgtcggtaaactcgttgcagaacgtgcaaacgctaaaggtatttcagaagtggtgttcgaccgcggtggatatctatatcacggacgtgtgaaagctttggctgatgcagctcgtgaaaacggattgaaattctaa

SEQ ID NO: 448 - DNA, 498 bp, Streptococcus pneumoniae
aaaatggcatttaaagacaatgcagttgaattagaagaacgcgtagttgctgtcaaccgtgttacaaaagttgttaaaggtggacgtcgtcttcgtttcgcagctcttgttgttgttggtgaccacaatggtcgcgtaggatttggtactggtaaagctcaagaagttccagaagcaatccgtaaagcagtagatgatgctaagaaaaacttgatcgaagttcctatggttggaacaacaatcccacacgaagttctttcagaattcggtggagctaaagtattgttgaaacctgctgtagaaggttctggagttgccgctggtggtgcagttcgtgccgttgtggaattggcaggtgtggcagatattacatctaaatcacttggttctaacactccaatcaacattgttcgtgcaactgttgaaggtttgaaacaattgaaacgcgctgaagaaattgctgcccttcgtggtatttcagtttctgatttggcataa

SEQ ID NO: 449 - DNA, 468 bp, Streptococcus pneumoniae
cattttacaaaagaggagaaaataaaaatgaaacttcatgaattgaaacctgcagaaggttctcgtaaagtacgtaaccgcgttggtcgtggtacttcatcaggtaacggtaaaacatctggtcgtggtcaaaaaggtcaaaaagctcgtagcggtggcggagttcgccttggttttgaaggtggacaaactccattgttccgtcgtcttccaaaacgtggattcactaacatcaacgctaaagaatacgcaattgtgaaccttgaccaattgaacgtctttgaagatggtgctgaagtaactccagttgttcttatcgaagcaggaattgttaaagctgaaaagtcaggtattaaaattcttggtaacggtgagttgactaagaaattgactgtgaaagcagctaaattctctaaatcagctgaagaagctatcactgctaaaggtggttcagtagaagtcatctaa

SEQ ID NO: 450 - DNA, 1314 bp, Streptococcus pneumoniae
cctatgttttttaaattattaagagaagctcttaaagtcaagcaggttcgatcaaaaattttatttacaatttttatcgttttggtctttcgtatcggaactagcattacagttcctggtgtgaatgccaatagcttgaatgctttaagtggattatccttcttaaacatgttgagcttggtgtcggggaatgccctaaaaaacttttcgatttttgccctaggagttagtccctatatcaccgcttctattgttgtccaactcttgcaaatggatattttacccaagtttgtagagtggggtaaacaaggggaagtaggtcgaagaaaattgaatcaagctactcgttatattgctctagttctcgcttttgtgcaatctatcgggattacagctggttttaataccttggctggagctcaattgattaaaactgctttaactccacaagtttttctgacgattggtatcatcttaacagctggtagtatgattgtcacttggttgggtgagcaaattacagataagggatacggaaacggtgtttccatgattatctttgccgggattgtttcctcaattccagagatgattcagggcatctatgtggactactttgtgaacgtcccaagtagccgtatcacttcatctatcattttcgtaatcattttgattattactgtattgttgattatttactttacaacttatgttcaacaagcagaatacaaaattccaatccaatatactaaggttgcacaaggtgctccatctagctcttaccttccgttaaaagtaaaccctgctggagttatccctgttatctttgccagttcgattactgcagcgcctgcggctattcttcagtttttgagtgccacaggtcatgattgggcttgggtaagggtagcacaagagatgttggcaactacttctccaactggtattgccatgtatgctttgttgattattctctttacattcttctatacgtttgtacagattaatcctgaaaaagcagcagagagcctacaaaagagtggtgcctatatccatggagttcgtcctggtaaaggtacagaagaatatatgtctaaacttcttcgtcgtcttgcaactgttggttccctcttccttggtgtgatttccattttaccgattgcagctaaagatgtatttggtctttctgatgttgttgcctttggtggaacaagtctcttgatcattatctctacaggtatcgaaggaatcaagcaattggaaggttacctattgaaacgtaagtatgttggtttcatggacagaacagaataa

SEQ ID NO: 451 - DNA, 651 bp, Streptococcus pneumoniae
ggagatcaaatcatgaatcttttgattatgggcttacctggtgcaggtaagggaactcaagcagcaaaaatcgtagaacaattccatgttgcacatatctcaacaggtgatatgttccgcgctgcaatggcaaatcaaactgaaatgggtgttcttgctaagtcatatattgacaagggtgaattggttcctgacgaagttacaaatggaatcgtaaaagaacgcctttcacaagatgatattaaagaaacaggattcttattggatggttacccacgtacaattgaacaagctcatgccttggacaaaacattggctgaacttggcattgaactagaaggtgttatcaatattgaagtgaaccctgacagccttttggaacgtttgagtgggcgtatcatccaccgcgtaactggagaaactttccacaaggtctttaacccaccagttgactataaagaagaagattactaccaacgtgaagatgataagcctgagacagtaaaacgtcgtttggatgttaatattgctcaaggagaaccaatcattgctcactaccgtgccaaaggtttggttcatgacatcgaaggtaatcaagatatcaatgatgtcttctcagatattgaaaaagtattgacaaatttgaaataa

SEQ ID NO: 452 - DNA, 378 bp, Streptococcus pneumoniae
aaaggagaaaacatggctcgtattgctggagttgatattccaaatgacaaacgcgtagtaatctcattgacttatgtttatggtatcggacttgcaacatctaagaaaattttggctgctgctggaatctcagaagatgttcgtgtacgtgatcttacatcagatcaagaagatgctatccgtcgtgaagtggatgcaatcaaagttgaaggtgaccttcgtcgtgaagtaaacttgaacatcaaacgtttgatggaaatcggttcataccgtggtatccgtcaccgtcgtggacttcctgtccgtggacaaaacactaaaaacaacgcccgcactcgtaaaggtaaagctgttgcgattgctggtaagaaaaaataa

SEQ ID NO: 453 - DNA, 396 bp, Streptococcus pneumoniae
gaggtaaaagtcttggctaaaccaacacgtaaacgtcgtgtgaaaaagaatatcgaatctggtattgctcatattcacgctacatttaataacactattgttatgattactgatgtgcatggtaatgcaattgcttggtcatcagctggtgctcttggtttcaaaggttctcgtaaatctacaccattcgctgctcaaatggcttctgaagctgctgctaaatctgcacaagaacacggtcttaaatcagttgaagttactgtaaaaggtccaggttctggtcgtgagtcagctattcgtgcgcttgctgccgctggtcttgaagtaacagcaattcgtgatgtgactccagtgccacacaatggtgctcgtcctccaaaacgtcgccgtgtataa

SEQ ID NO: 454 - DNA, 402 bp, Streptococcus pneumoniae
ataaaggaggaatacatggcttaccgtaaactaggacgcactagctcacaacgtaaagcaatgcttcgcgatttgacaactgaccttttgatcaacgaatcaatcgtgacaactgaagctcgtgctaaagaaatccgtaaaactgttgaaaaaatgattactctaggtaaacgtggtgatttgcatgcacgtcgtcaagcagctgctttcgtacgtaatgaaatcgcatctgaaaactatgatgaagcaactgataagtacacttctactacagcacttcaaaaattgttctcagaaatcgcacctcgttatgctgaacgtaacggtggatacactcgtatccttaaaactgaatcacgtcgtggtgatgcagcgccaatggcgatcatcgaattagtataa

SEQ ID NO: 455 - DNA, 414 bp, Streptococcus pneumoniae
atgcctacaattaaccaattggttcgcaaaccgcgtaaatcaaaagtagaaaaatctaaatcaccagctttgaacgttggttacaatagtcataaaaaagttcaaacaaacgtttcttcaccacaaaaacgtggtgttgcaactcgtgttggaacaatgacacctaaaaaacctaactcagcccttcgtaaattcgctcgtgtacgtttgagcaaccttatcgaagttactgcctacatcccaggtatcggacacaacttgcaagagcacagcgtggtgcttcttcgcggtggacgtgtaaaagaccttccaggggtacgttaccatatcgtccgtggtgcacttgatactgcaggtgttaacgatcgtaaacaaggccgttctaaatacggtactaaacgtccaaaagcataa

SEQ ID NO: 456 - DNA, 477 bp, Streptococcus pneumoniae
agagaaatgagtcgtaaaaatagagctccaaaacgtgacgtattgccagatccgctatacaattcacaactagttactcgtcttatcaaccgcgttatgcttgatggtaaacgtggtactgctgcttcaatcgtttacggtgcttttgagcaaatcaaagaagctactggcaacgatgcacttgaagtatttgaaacagctatggaaaacatcatgcctgtacttgaagtacgtgcacgtcgtgttggtggttctaactaccaagtcccagttaaagttcgtccagaacgtcgtacaacacttggacttcgttggttggtaacaatcgctcgtcttcgtggtgaacacacaatgcaagaccgtcttgcaaaagaaatcttggatgctgctaacaacactggtgcagcagttaagaaacgtgaagatactcaccgtatggctgaagctaaccgtgcattcgcacacttccgttggtaa

SEQ ID NO: 457 - DNA, 930 bp, Streptococcus pneumoniae
gaaaggactgaaaacatcatgactgaaaaacttcaattaactaaatcagatcgtaaaaaagtttggtggcgttcaaccttcttacaagggtcttggaactttgaacggatgcaaaacttgggctgggcttatacactcattccagctatcaaaaaactctatactaaaaaagaagatcaaatcgctgctcttgagcgtcaccttgagttcttcaacactcatccatacgtagctgctccagtcatgggggttactcttgcgcttgaagaagaacgtgctaacggtgtggaaatcgatgacgctgctatccaaggggttaaaatcggtatgatgggacctcttgctggtatcggtgacccagtattctggtttacagtacgcccaatccttggatctctcggtgcttcacttgcccttactggcaatatcttggggccactcctcttctttgttgcatggaacttgattcgtatgtcattcttgtggtatgttcaagagattggatacaaggctggatcagaaatcactaaagatatgtctggtggtatccttcaagatatcactaaaggagcttctatccttgggatgttcattcttgctgtccttgttcaacgctgggtaaatattaaatttgctttcgatgtttctaaagttcaactagatgaaaaggcttatatccattgggataaattgccagaagggtctaaaggtatccaagaagcattcgcacaagtaggacaaggattgtctcaaactcctgaaaaagttactactttccaacaaaacttggatatgttgattcctggattatcaggactactccttactttactttgcatgtacttacttaagaaaaaagtatctccaatcactattatccttgccctcttcgcagtgggtattgtggcacatgttcttcacatcatgtaa

SEQ ID NO: 458 - DNA, 831 bp, Streptococcus pneumoniae
gccattatttatgaaaggattttaaacatgtctattatttctatggttttagtagtcgttgtagccttctttgcaggtcttgaaggcatcctcgaccagttccaatttcaccaaccacttgtagcctgtacccttattgggcttgtaacaggtcacttggaagcagggattatcctcggtggatcgcttcaaatgattgcccttggttggtcaaatatcggtgctgctatcgctcctgatgctgcacttgcttctgtcgctgctgccattatcatggttcttggtggtgactttaccaagactggtatcggtgttgcccaagcggttgctatccctcttgctgtagctggacttttcttgacaatgattgttcgtacaatttcagttggtttggttcatactgcagatgctgccgctaaaaaaggtgacttcggcgctgtggagcgtgcgcatttcatcgcgctacttttccaaggacttcgtatcgcgcttcctgcagctcttctccttatggtaccaactgaaactgtacaaagtatccttagtgccatgccagactggctcaaagatggtatggctatcggtggtggtatggtcgttgccgttggttacgccatggttatcaacatgatggcaactcgtgaagtatggccattcttcgctcttggtttcgttctcgctgctgtgtcagatattactctaatcggattcggtgctatcggcgttgctatcgctcttatctaccttcacctttctaaaactggtggaaatggtggcggaggagccgcaacttctaacgacccaatcggcgatatcctagaagactactaa

SEQ ID NO: 459 - DNA, 1014 bp, Streptococcus pneumoniae
aacaaaaaaggaggaatgacaataatgagtatcggaatcattattgcgagccacggcgaatttgctgcgggtattcatcagtcaggatctatgatctttggtgaacaagaaaaggttcaagttgtgacctttatgccaaatgaaggtcctgatgatctatacgctaagtttaataacgctgttgctgcatttgacgcagaagatgaggttctagttttggctgacctttggagtggttctccatttaaccaagctagtcgcgtgatgggagaaaatcctgagcgtaagtttgccatcatcacaggacttaacttaccgatgttgattcaagcctacacagagcgcctcatggacgctgctgcaggtgtagaaaaagtcgctgctaatatcattaaagaagccaaagatggcatcaaagctcttccagaagagctaaatccagtcgaagaagttgcaagcgctgcagctgctccagttgcccaaactgctatcccagaaggaactgttatcggagacggtaaattgaaaatcaatcttgcccgtcttgacacacgtctacttcacggtcaggttgcaactgcttggactccagattcaaaagcaaatcgtatcatcgttgcttcagataacgtggctaaagacgaccttcgtaaagaattgattaaacaagcagctccaggtaatgtcaaggctaacgtggttccaattcaaaaactgattgagatttcaaaagacccacgttttggagaaacacatgcccttatcttgtttgaaacacctcaagatgcccttcgtgccatcgaaggcggcgtgccaatcaagactcttaatgttggttctatggctcactcaacaggtaaaacattggtcaataccgttttgtctatggacaaagaagacgttgctacatttgaaaaaatgcgtgacttgggtgttgaatttgatgtccgtaaagtaccaaatgattctaaaaaagatttgtttgacttgattaacaaagccaatgtcaaataa

SEQ ID NO: 460 - DNA, 1128 bp, Streptococcus pneumoniae
tatacttcacatataaatacaagagagctcgtcacactcgactctgttgacaaaaaatcaatccagtcccgttgtccctgttctcggtcaatatcaaggaggatagctatgaaagctgttgttgtaaatccagaaagcactggtgttgctattgaagaaaaagtactccgtccacttgaaactggggaagcacttgtagaagttgaatactgtggcgtttgccacaccgacctccacgttgctcatggtgactttggtcaagtcccaggacgtgttcttgggcacgaaggtatcggtatcgttaaagagattgctccagatgtgaaaagccttaaagtcggtgaccgcgtcagcgttgcttggttctttgaaggatgtggcacttgcgaatactgtacaactggtcgcgaaaccctttgccgtacagtgaaaaatgctggctactcagtagacggtggtatggctgaacaatgtatcgtaactgctgactatgctgtcaaagttcctgacggacttgatccagcccaagcttcttctatcacatgtgctggagtaacaacctataaagctatcaaagaagcaaaagttgaaccaggccaatgggttgttctttacggtgctggtggacttggtaacctcgctgttcaatacgctaaaaaagtattcaatgctcatgttatcgcagtcgatatcaacaatgacaaacttgcccttgcaaaagaagtaggcgctgacattgtgattaacggcctcgaagttgaagatgtagctggactcattaaagaaaaaactgatggaggagctcattcagctgtcgtaactgctgtgtctaaagttgccttcaaccaggctgttgactccattcgtgctggtggtcgcgtcgtcgctgttggtcttccttctgaaatgatggaactcagcatcgttaaaacagtcctcgatggaatccaagtcatcggttctcttgtcggaactcgtaaagacttagaagaagccttccaatttggtgcagaaggtctggtagtcccagttgttcaaaaacgtccagtagaagatgctgttgccattttcgacgaaatggaaaaaggccaaatccaaggacgtatggtactcgacttcacccactaa

SEQ ID NO: 461 - DNA, 477 bp, Streptococcus pneumoniae
acaaaaatcgaactatatataggagaaatcatgaacaaaacaacatttatggctaaaccaggccaagttgaacgtaaatggtacgtagttgacgcaactgatgtaccacttggacgtctttctgcagtagttgctagcgtacttcgcggaaaaaacaaaccaacatttacaccacacactgatacaggtgacttcgtgattgttatcaatgctgaaaaagttaaattgactggtaaaaaagcaactgataaaatctactacactcactcaaaccacccaggtggattgaaacaaatctctgcaggtgaacttcgttctaaaaatgcagtacgtttgattgagaaatcagttaaaggtatgcttccacacaatacacttggacgcgctcaaggtatgaagttgaaagtatttgttggagctgagcacactcacgctgcacaacaaccagaagttcttgacatttcaggacttatctaa

SEQ ID NO: 462 - DNA, 396 bp, Streptococcus pneumoniae
agtatgtcacaagcacaatatgcaggtactggacgtcgtaaaaacgctgttgcacgcgttcgccttgttccaggaactggtaaaatcactgttaacaaaaaagatgttgaagagtacatcccacacgctgaccttcgtcttgtcatcaaccaaccattcgcagttacttcaactgtaggttcatacgacgttttcgttaacgttataggtggtggatacgctggtcaatcaggagctatccgtcacggtatcgctcgtgcccttcttcaagtagacccagacttccgcgattcattgaaacgcgcaggacttcttacacgtgactcacgtaaagttgaacgtaagaaaccaggtcttaagaaagctcgtaaagcatcacaatttagtaaacgttaa

SEQ ID NO: 463 - DNA, 834 bp, Streptococcus pneumoniae
aggaggaagcacacgatgactggatctaacaaattaacaaaacgtgattatcttaaaacgtctttgcgggcattcttttgtcaaaatggatttaactatagtaactatcaagggttgggatatgccaatgtgatgtatcctgctttgaaaaaacactatggagaggatcaggaaggtttctaccaagccttggaagaaaactgtgaattctataataccaacccacacttcctgccttttattaccagcttgcatcttgtaatgttggaaaatggccgtccggcaaaagaaacacgtagcatcaagatggccttgatgggaccattggcaggtattggggattctctttctcaattctgtttagctccattgttctcaaccatcgcagcttcgtttgctcaagaaggcttggttgtcggtccaatcttgttcttccttgcgatgaatacgattttaacagcgattaaattgtcaactggtctgtatggatacaaactaggaacaactgtgattgataaactaagcgaacagatggcaacgatttctcgtattgccaatattatcggtgtaaccgtaattgctggtttggcagcgacatctgttaagattatggtgccgattacctttgctgcaggggaagttaaagcagacgctaaacaaagtatcgtaagtattcagggaatgcttgataaggttgctccagctcttctaccagccctatttacacttttagtttactacttgatcaaagaaaagaaatggacaacatataaactcgttattttaacagttatcatcggaattatcggaagctggcttaagattatagcttaa

SEQ ID NO: 464 - DNA, 1533 bp, Streptococcus pneumoniae
tttcctaacttccaattttttattataatagagtccagaggtaaaaaaatgaaaaaacaagcttttagttctgaacaatatttgaatttacaacgcgaccatattttggagcgcattaaccaatttgacggcaagctctacttagagtttggcggtaaaatgttagaagatttccacgctgctcgtgtccttcctggttatgaacctgacaacaaaatcaagctcttgcaagaattgaaagagcaggttgaggttgtgattgccattaatgctagcaacattgaacattccaaagcacgtggcgacttaggcatttcttatgaccaagaagttcttcgtttgattgataaattcaatgaattagggatttttgttggttccgttgtcattacacaatacgctggccaacccgctgcagatgccttccgcaatcaacttgagaaaaacggaattgattcttatcttcattatccaatcaaaggatatccgacggatatggatcacatcatttccccagaaggcatgggcaaaaacgactacatcaaaaccagtcgcaacttgattgtcgtaaccgctcctggacctggttctggaaaattggcaacgtgtatgtccaatatgtaccacgaccaaatcaatggcatcaaatctggctacgctaaatttgaaaccttccctgtttggaatcttccccttcatcatccagttaacttggcttatgaagctgccacagctgaccttgatgatgtcaacatgattgaccccttccatcttcaaacctatggagaaaccactgtcaactacaaccgtgatatcgaaatcttcccagtgctcaaacgcatgttggaacgtattctcggaaaatcaccatacgcttcaccgacagatatgggtgtcaacatggttggtttcgctattacagatgacgaggccgctgtcgaagcttctaaacaagaaatcatccgccgttactatcaaacagttcttgacttcaaagctgaaaaagttggcgaagctgccgtcaagaaaattgagttgctcatgaacgacctcggtatcacacctgcagaccgtaaggttgctgtcgttgcgcgccaaaaagcagaagaaactggtggaccagccctagcctttgaattgccaaatggggaaatcatcactggtaagaactcagaactctttggtcctacagccgctgccttgatcaacgccatcaaaaaatcagctgacatcgctaaagaagtaaaactaatcgagcctgaagttgttaagccaatccaaggtcttaaaatcgatcatctcggtagccgcaatccacgccttcattcaaatgaaatcctgattgcacttgctatcacagctacagaaaatcctgatgctgcccgcgctatggaagaactcggcaacctcaaaggaagcgaagcccactcaaccatcatcttgactgatgaagacaagaatgtccttcgtaaactgggtatcaacgtaacctttgacccatactaccaatacgaccgcttatatcgtaagtaa

SEQ ID NO: 465 - DNA, 2166 bp, Streptococcus pneumoniae
aacaagatgaacaaaccaacgattctgcgcctaatcaagtatctgagcattagcttcttaagcttggttatcgcagccattgtcttaggcggaggagtttttttctactacgttagcaaggctcctagcctatccgagagtaaactagttgcaacaacttctagtaaaatctacgacaataaaaatcaactcattgctgacttgggttctgaacgccgcgtcaatgcccaagctaatgatattcccacagatttggttaaggcaatcgtttctatcgaagaccatcgcttcttcgaccacagggggattgataccatccgtatcctgggagctttcttgcgcaatctgcaaagcaattccctccaaggtggatcaactctcacccaacagttgattaagttgacttacttttcaacttcgacttccgaccagactatttctcgtaaggctcaggaagcttggttagcgattcagttagaacaaaaagcaaccaagcaagaaatcttgacctactatataaataaggtctacatgtctaatgggaactatggaatgcagacagcagctcaaaactactatggtaaagacctcaataatttaagtttacctcagttagccttgctggctggaatgcctcaggcaccaaaccaatatgacccctattcacatccagaagcagcccaagaccgccgaaacttggtcttatctgaaatgaaaaatcaaggctacatctctgctgaacagtatgagaaagcagtcaatacaccaattactgatggactacaaagtctcaaatcagcaagtaattaccctgcttacatggataattacctcaaggaagtcatcaatcaagttgaagaagaaacaggctataacctactcacaactgggatggatgtctacacaaatgtagaccaagaagctcaaaaacatctgtgggatatttacaatacagacgaatacgttgcctatccagacgatgaattgcaagtcgcttctaccattgttgatgtttctaacggtaaagtcattgcccagctaggagcacgccatcagtcaagtaatgtttccttcggaattaaccaagcagtagaaacaaaccgcgactggggatcaactatgaaaccgatcacagactatgctcctgccttggagtacggtgtctacgattcaactgctactatcgttcacgatgagccctataactaccctgggacaaatactcctgtttataactgggataggggctactttggcaacatcaccttgcaatacgccctgcaacaatcgcgaaacgtcccagccgtggaaactctaaacaaggtcggactcaaccgcgccaagactttcctaaatggtctaggaatcgactacccaagtattcactactcaaatgccatttcaagtaacacaaccgaatcagacaaaaaatatggagcaagtagtgaaaagatggctgctgcttacgctgcctttgcaaatggtggaacttactataaaccaatgtatatccataaagtcgtctttagtgatgggagtgaaaaagagttctctaatgtcggaactcgtgccatgaaggaaacgacagcctatatgatgaccgacatgatgaaaacagtcttgacttatggaactggacgaaatgcctatcttgcttggctccctcaggctggtaaaacaggaacctctaactatacagacgaggaaattgaaaaccacatcaagacctctcaatttgtagcacctgatgaactatttgctggctatacgcgtaaatattcaatggctgtatggacaggctattctaaccgtctgacaccacttgtaggcaatggccttacggtcgctgccaaagtttaccgctctatgatgacctacctgtctgaaggaagcaatccagaagattggaatataccagaggggctctacagaaatggagaattcgtatttaaaaatggtgctcgttctacgtggaactcacctgctccacaacaacccccatcaactgaaagttcaagctcatcatcagatagttcaacttcacagtctagctcaaccactccaagcacaaataatagtacgactaccaatcctaacaataatacgcaacaatcaaatacaacccctgatcaacaaaatcagaatcctcaaccagcacaaccataa

SEQ ID NO: 466 - DNA, 351 bp, Streptococcus pneumoniae
caagcgagaatggagagagacatggcaagtattattttttcagcgaaagatatttttgaacaagagtttggacgtgaggtccgtggctataataaagtagaagttgacgagtttttagacgatgtcatcaaggactatgaaacctatgctgccttggtcaagtcacttcgtcaggaaattgcggatttgaaggaagaattaactcgtaaaccgaaaccttcaccagttcaagcagaaccccttgaagcggcaattacaagttctatgacgaattttgatattttgaaacgcctgaatagattggaaaaagaagtttttggtaaacaaattttagataactcagatttttaa

SEQ ID NO: 467 - DNA, 1407 bp, Streptococcus pneumoniae
aaagggatactcatgagtaaaaaaagacgaaatcgtcataaaaaagaaggtcaagaaccgcaatttgattttgatgaagcaaaagagctaacagttggtcaagctattcgtaaaaatgaagaagtggaatcaggagtcttgcctgaggattccattttggacaagtatgttaagcaacacagagatgaaattgaggcggataagtttgcgactcgtcaatacaaaaaagaggagttcgttgaaactcagagtctggatgatttaattcaagagatgcgtgaggctgtagagaagtcagaagcttcttcggaggaagttccatcttctgaagacatcttactacccttgcctctggacgatgaggagcaaggcttggatcctctattgctagatgatgaaaatccaacagaaatgactgaagaagtggaagaggagcaaaacctttctcgtctggatcaagaggactcagaaaagaaaagtaaaaaaggctttattttgaccgttttggcgcttgtatcagtaattatttgtgtcagtgcttattatgtctaccgtcaagtggctcgttcgactaaggaaattgaaacttctcaatcaactacagccaatcaatcggatgtggatgattttaatacactttatgacgccttttacacagatagcaataaaacggctttgaaaaatagccagtttgataaactgagtcaactcaagactttacttgataagctggaaggtagtcgtgaacatacgcttgccaaatctaaatatgatagtctagcaacgcaaatcaaggctattcaagatgtcaatgctcaatttgagaaaccagctattgtggatggtgtgttggataccaatgccaaagccaaatcggatgctaaatttacggatattaaaactggaaatacggagcttgataaagtgctagataaggctatcagtcttggtaagagccagcaaacaagtacttctagctcaagttcaagtcaaactagcagctcaagttcaagtcaagcaagttcaaatacgactagtgagccaaaaccaagtagttcaaatgagactagaagtagtcgcagtgaagtcaatatgggtctctcgagtgcaggggttgctgttcaaagaagtgccagtcgtgttgcctataatcagtctgctattgatgatagtaataactctgcctgggattttgcggatggtgtcttggaacaaattctagcgacttcacgttcacgtggctatatcactggagaccaatatatccttgaacgtgtcaatatcgttaacggcaatggttattacaacctctacaagccagatggaacctatctctttacccttaactgtaagacaggctactttgtcggaaatggcgctggtcatgcggatgacttagattactaa

SEQ ID NO: 468 - DNA, 1500 bp, Streptococcus pneumoniae
gcagtcgttacaaaattctttcttttcaaaagtaaaaatgataaaataaaacaaatgaaacaagaggagtgtcaaatgacaaaagctaactttggtgtcgtaggtatggccgtaatgggtcgtaaccttgcccttaatattgaatctcgtggttacacagttgctatctacaaccgtagtaaagaaaaaacggaagatgtgattgcttgccatcctgaaaagaactttgtaccaagctatgacgttgaaagttttgtaaactcaatcgaaaaacctcgtcgtatcatgctgatggttcaagctggacctggtacagatgctactatccaagcccttcttccacaccttgacaagggtgatatcttgattgacggaggaaatactttctacaaagataccatccgtcgtaatgaagaattggcaaactctggtatcaactttatcggtactggggtttctggtggtgaaaaaggtgcccttgaaggtccttctatcatgcctggtggacaaaaagaagcctacgaattggttgcggatgttcttgaagaaatctcagctaaagcaccagaagatggcaaaccatgtgtgacttacatcggtcctgatggagctggtcactatgtgaaaatggttcacaatggtattgagtacggtgatatgcaattgatcgcagaaagctatgacttgatgcaacacttgctaggcctttctgcagaagatatggctgaaatctttactgagtggaacaagggtgaattagacagctacttgattgaaatcacagctgatatcttgagccgtaaagacgatgaaggccaagatggaccaatcgtagactacatccttgatgctgcaggtaacaagggaactggtaaatggactagccaatcatctcttgaccttggtgtaccattgtcactgattactgagtcagtgtttgcacgctacatttcaacttacaaagaagaacgtgtacatgctagcaaggtgcttccaaaaccagctgccttcaactttgaaggagacaaggctgaattgattgaaaagatccgtcaagccctttacttctcaaaaatcatttcatacgcacaaggatttgctcaattgcgtgtagcctctaaagaaaacaactggaacttgccatttgcagatatcgcatctatctggcgtgatggctgtatcatccgttctcgtttcttgcaaaagattacagatgcttacaaccgcgatgcagatcttgccaaccttcttttggacgagtacttcttggatgttactgctaagtaccaacaagcagtacgtgatatcgtagctcttgcggttcaagcaggtgtgccagtgccaactttctcagcagctattacttactttgatagctaccgttcagctgaccttccagctaacttgatccaagcacaacgtgactactttggtgctcacacttaccaacgtaaagacaaagaaggaaccttccactactcttggtatgacgaaaaataa

SEQ ID NO: 469 - DNA, 438 bp, Streptococcus pneumoniae
aaaatggactaccaacgaatcaatgaatatttaacatctatatttaacaatgtccttgtaattgaggaagtgaacttgagaggtagtcgttttaaggatatctccatcaaagaaatgcatacgattgatgtcatcggtaaggctccagacgtgactccaagtcaagtgtcaaaagagttgatggtaactcttggaactgttacgacaagtttgaacaatttagagcgtaagggctacattgagcgagttcggtcagaacaggatcgtcgtgtggtgcatctgcatttgacaaagaagggtcgcttgattcatagactgcataaacgcttccacaaggccatggtagaaaaaattattgatggcatgagcgaggaagaaattgctgtcatgggtaaaggtttgactaatctttaccaatttttggaggatttgaaataa

SEQ ID NO: 470 - DNA, 237 bp, Streptococcus pneumoniae
aggagtcctatcatggcagtatttgaaaaagtacaagaaattatcgttgaagaacttggaaaagacgcatcagaagtaacacttgaatcaacttttgatgatttggacgcagattcattggacttgttccaagtaatctcagaaatcgaagatgcttttgatatccaaatcgaagcagaaaatgacttgaaaacagttggtgacttggttgcttacgttgaagagcaagcaaaataa

SEQ ID NO: 471 - DNA, 2343 bp, Streptococcus pneumoniae
aaaaaagaggacattaatatggttgttaagacagttgttgaagcacaagatatttttgacaaagcttgggaaggcttcaaaggcgtagattggaaagaaaaagcaagtgtatcacgatttgtacaagctaactacacaccttatgatggagacgaaagcttccttgcaggaccaacagagcgttcacttcacatcaagaaaattgtagaagaaactaaagcacactacgaagaaactcgtttcccaatggacactcgtccaacatctatcgctgatatccctgctggatttatcgacaaagaaaatgaagttatcttcggtatccaaaacgatgaactcttcaaattgaacttcatgccaaaaggtggtatccgtatggctgaaactactttgaaagaaaatggatacgaaccagacccagctgttcacgaaatcttcactaaatatgtaacaacagttaacgacggtattttccgtgcctacacttcaaatattcgtcgcgctcgtcacgcacacactgtaactggtcttccagatgcatactcacgcggacgtatcatcggtgtttacgcacgtcttgctctttacggtgcagactacttgatgcaagaaaaagtaaatgactggaatgcaatcaaagaaatcgatgaagaaacaatccgtcttcgtgaagaagtaaaccttcaataccaagcattgcaacaagttgttcgcctgggtgacctttacggggttgatgttcgcaaaccagcgatgaacgtgaaagaagcaatccaatgggttaacattgctttcatggctgtctgccgtgtgattaacggtgctgctacatctctaggtcgtgtaccaatcgtattggacatctttgcagaacgtgaccttgctcgtggtacatttactgaatcagaaatccaagaattcgttgatgatttcgttatgaaacttcgtacagttaaatttgctcgtacaaaagcttatgaccaattgtactcaggtgacccaacctttatcacaacttctatggctggtatgggtaacgacggtcgtcaccgtgttactaagatggactaccgtttcttgaacactcttgacaacatcggtaactcaccagaaccaaacttgacagttctttggactgacaaattgccatacaacttccgtcgctactgtatgcacatgagccacaaacactcttctatccaatacgaaggtgtaacaacaatggctaaagacggatatggtgaaatgagctgtatctcatgctgtgtgtctccacttgatccagaaaatgaagaacaacgccacaacatccagtacttcggtgctcgtgtaaacgttcttaaagcccttcttactggtttgaatggtggttacgacgatgttcacaaagactacaaagtatttgatatcgaaccaatccgtgacgaagttcttgaatttgaatcagttaaagcgaactttgaaaaatctcttgactggttgactgacacttacgtagatgccttgaacatcatccactacatgactgataggtacaactacgaagctgttcaaatggccttcttgccaactaaacaacgtgccaacatgggattcggtatctgtggatttgctaacactgttgatacattgtcagctatcaaatacgctacagttaaaccaatccgtgacgaagatggctacatctacgattacgaaacaatcggtgactacccacgctggggtgaagatgacccacgttcaaacgaattggcagaatggttgatcgaagcttacacaactcgtctacgtagccacaaactatacaaagacgcagaagctacagtatcacttttgacaatcacatctaacgttgcttactctaaacaaactggtaactcaccagttcacaaaggtgtatacctcaacgaagatggttctgtgaacttgtctaaacttgaattcttctcaccaggtgctaacccatctaacaaagctaaaggtggttggttgcaaaacttgaactcactttctagccttgactttagttatgcagctgacggtatctcattgactacacaagtatcacctcgcgctcttggtaagactcgtgatgaacaagttgataacttggtaacaattcttgatggttacttcgaaaacggtggacaacacgttaacttgaacgttatggacttgaacgatgtttacgaaaaaatcatgtcaggcgaagacgttatcgtacgtatctctggatactgtgtaaacactaaatacctcactccagaacaaaaaactgaattgacacaacgtgtcttccacgaagttctttcaatggatgacgccttggatgcattgagctaa

SEQ ID NO: 472 - DNA, 1620 bp, Streptococcus pneumoniae
aaagaggaatctatgtctacgaaatatatttttgtaactggtggtgtggtatcgtccattgggaaagggattgtggcagcgagtctaggccgtctcttgaaaaatcgtggtctcaaagtaaccattcaaaagtttgacccttatatcaatattgatccgggaaccatgagtccttaccagcacggggaagtttttgtgacagatgacggagctgagacagatttggacttgggtcactatgaacgtttcatcgatatcaatctcaacaaatattccaacgtgacaactgggaaaatttacagtgaagttcttcgtaaagaacgccgtggagaataccttggggcaactgttcaagtcattcctcatatcacagatgctttgaaagaaaaaatcaagcgtgccgctctaacgaccgactctgatgtcattatcacagaggttggtggaacagtaggagatatcgagtccttgccattcctagaggctcttcgtcagatgaaggcagatgtgggtgcggataatgtcatgtatatccatacaaccttgcttccttacctcaaggctgctggtgaaatgaaaaccaaaccaacccaacactctgtcaaagaattgcgtggcttgggaatccaaccaaatatgttggttattcgtacagaagagccagctggtcaaggaattaaaaataaactggcccagttctgtgatgtggcaccagaagccgttatcgaatcgttggatgttgaacacctttaccaaattccactgaacttgcaggcacaagggatggaccaaattgtttgtgatcatttgaaattagacgcaccagcagcggatatgacagaatggtcagccatggtggacaaggtcatgaacctcaagaaacaagttaagatttcccttgttggtaagtatgtggagttgcaagatgcctatatctcagtggtcgaagccttgaaacactctggctatgtcaatgatgcagaagttaaaatcaattgggtcaatgccaatgatgtgacagcagagaatgtagcagaactcttgtctgatgcggacgggatcatcgtaccaggtggttttggtcaacgtggtacagaagggaaaatccaagccatccgctatgcgcgtgaaaatgatgttccaatgttgggagtctgcttgggaatgcagttgacatgtatcgagtttgctcgtcacgttttaggtcttgaaggtgccaattctgcagagcttgcaccagaaacaaaataccctatcattgatatcatgcgtgatcagattgatattgaggatatgggtggaacccttcgtttgggactttatccgtctaagttgaaacgtggctctaaggctgctgctgcttatcacaatcaagaagtggtgcaacgccgtcaccgtcaccgttatgagtttaataatgccttccgtgagcagtttgaggcagcaggttttgtcttttcaggagtttctccagacaatcgtttggtagaaatcgtggaaattcctgaaaataaattctttgtagcttgtcagtatcaccctgaactgtcaagccgtccaaaccgaccagaagaactctacactgcctttgttactgcagcagttgagaacagcaattag

SEQ ID NO: 473 - DNA, 1140 bp, Streptococcus pneumoniae
attatgaacaatactgaattttatgatcgtctgggggtatccaaaaacgcttcggcagacgaaatcaaaaaggcttatcgtaagctttccaaaaaatatcacccagatatcaacaaggagcctggtgctgaggacaagtacaaggaagttcaagaagcctatgagactttgagtgacgaccaaaaacgtgctgcctatgaccagtatggtgctgcaggcgccaatggtggttttggtggagctggtggtttcggcggtttcaatggggcaggtggcttcggtggttttgaggatattttctcaagtttcttcggcggaggcggttcttcgcgcaatccaaacgctcctcgccaaggagatgatctccagtatcgtgtcaatttgacctttgaagaagctatcttcggaactgagaaggaagttaagtatcatcgtgaagctggctgtcgtacatgtaatggatctggtgctaagccagggacaagtccagtcacttgtggacgctgtcatggcgctggtgtcattaacgtcgatacgcagactcctcttggtatgatgcgtcgccaagtaacctgtgatgtctgtcacggtcgaggaaaagaaatcaaatatccatgtacaacctgtcatggaacaggtcatgagaaacaagctcatagcgtacatgtgaaaatccctgctggtgtggaaacaggtcaacaaattcgcctcgctggtcaaggtgaagcaggctttaacggtggaccttatggtgacttgtatgtagtagtttctgtggaagctagcgacaagtttgaacgtgaaggaacgactatcttctacaatctcaacctcaactttgtccaagcggctcttggtgatacagtagatattccaactgttcacggtgatgttgaattggttattccagagggaactcagactggtaagaagttccgcctacgtagtaagggggcaccgagccttcgtggcggtgcagttggtgaccaatacgttactgttaatgtcgtaacaccgacaggcttgaacgaccgccaaaaagtagccttgaaagaattcgcggctgctggtgacttgaaagtaaatccaaagaaaaaaggcttctttgaccatattaaagatgcctttgatggagaataa

SEQ ID NO: 474 - DNA, 297 bp, Streptococcus pneumoniae
ggagttgctatgaaattatccaacctactgctatttgcaggagctgcagccggaagttatctggttacaaaaaatcgccaaaccatcacagatgaagtcttgaataccactgaccgcgttcaagctatcaaggacgatgtggatattatccaaaacagcctgcaaatcattaaccagcaaaaagaacttatcaaggaataccaagaagacttgacttacaagtttaaggtcttggaaaaggatatccagactagactagctgtgataaaagaaatgcagggaactgaagataagtaa

SEQ ID NO: 475 - DNA, 1158 bp, Streptococcus pneumoniae
ggattcaaaagtgaagaaaacatgagtaaagaaatgctagaggccttccgcattttggaagaagacaagggaatcaaaaaagaagatatcatcgacgcagtagtagagtcgcttcgttccgcttatcgcagacgctatggtcagtcagacagcgtagctattgacttcaacgaaaaaacaggtgactttacagtttatactgtccgtgaagttgttgatgaagtatttgatagccgtttggaaatcagcttgaaagatgctcttgccattaattcagcttatgaacttggagacaaaatcaagtttgaagaagcaccagctgagtttggtcgtgtagcagcccaatctgccaaacaaaccatcatggaaaaaatgcgcaagcaaacacgtgccatcacttacaatacttacaaagaacatgagcaagaaatcatgtctggtacagtagaacgctttgacaaccgctttatctatgtcaaccttggtagcatcgaagcccaattgtcaaaacaagaccaaattcctggagaagtttttgcttctcatgatcgtatcgaagtttatgtttacaaggttgaagacaaccctcgtggtgtgaacgtctttgttagccgtagtcatccagaaatgatcaaacgtttaatggagcaagaaattccagaagtttatgatggaactgttgaaatcatgagcgtggctcgtgaagcaggtgaccgtacgaaggttgctgttcgtagccacaatccaaacgtggatgctatcggtacaatcgttggacgtggtggtgctaatatcaagaagattactagcaaattccacccagctcgttacgatgctaaaaatgaccgcatggtaccaatcgaagaaaatatcgatgttatcgagtgggtagcagatccagctgaatttatctacaatgccatcgctcctgctgaggttgaccaagttatctttgatgaaaacgacagcaaacgtgccttggtggttgttccagataacaagctttctcttgccattggtcgtcgtggacaaaacgtgcgcttggcggctcacttgactggttaccgtatcgatatcaagtctgctagcgaatttgaagccatggaagacgctgcttcagtagagttggaagtagaaaacgatactgtagaagaataa

SEQ ID NO: 476 - DNA, 2910 bp, Streptococcus pneumoniae
ggtctcttatggaatagaagaggaggacatgatttgtctaagaaaagattgtacgaaatcgcaaaagaacttggaaaagaaagtaaagaagttgtagcgcgtgcaaaagagttgggcttggatgtgaaaagccactcatcaagtgtggaagaagctgtcgctgcaaaaattgctgccagctttaagcctgcagctgctccgaaagtagaagcaaaacctgcagccccaaaagtaagtgcagaaaagaaagccgaaaaatctgagccagctaaaccagctgtagctaaggaagaggcaaaacctgcagccccaaaagcaagtgcagaaaagaaagccgaaaagtctgaaccagtaaaaccagctgtagccaaggaagaggcaaaaccagctgagccagtcactccgaaaacagaaaaagtagcggctaaaccgcaaagtcgtaatttcaaggctgagcgtgaagcacgtgctaaagagcaggcagagcgacgcaagcaaaataagggcaataaccgtgaccaacaacaaaacggaaaccgtcagaaaaacgacggccgtaatggtggaaaacaaggtcaaagcaaccgcgacaatcgtcgctttaatgaccaagctaagaagcagcaaggtcagcaaaaacgtagaaatgagcgccgtcagcaagaggataaacgttcaaatcaagcggctccacgtattgactttaaagcccgtgcagcagccctaaaagcagagcaaaatgcagagtacgctcgttcaagtgaggaacgcttcaagcagtatcaggctgctaaagaagccttggctcaagctaacaaacgcaaggaaccagaggaaatctttgaagaagcggctaagttagctgaacaagcacagcaagttcaagcagtggttgaagtcgtccctgagaaaaaagaacctgcagtggatacacgtcgtaaaaaacaagctcgaccagacaaaaatcgtgacgattatgatcatgaagaagatggtcctagaaaacaacaaaagaatcgaagtagtcaaaatcaagtgagaaatcaaaagaatagtaactggaataacaacaaaaagaacaaaaaaggcaataacaagaacaaccgtaatcagactccaaaacctgttacggagcgtaaattccatgaattgccaacagaatttgaatatacagatggtatgaccgttgcggaaatcgcaaaacgtatcaaacgtgaaccagctgaaattgttaagaaacttttcatgatgggtgtcatggccacacaaaaccaatccttggatggggaaacaattgaactcctcatggtggattacggtatcgaagccaaacaaaaggttgaagtggataatgctgacatcgaacgtttctttgtcgaagatggttatctcaatgaagatgaattggttgagcgtccaccagttgttactatcatgggacacgttgaccacggtaaaacaacccttttggatactcttcgtaactcacgtgttgcgacaggtgaagcaggtggtattactcagcatatcggtgcctaccaaatcgtggaaaatggtaagaagattaccttccttgatacaccaggacacgcggcctttacatcaatgcgtgcgcgtggtgcttctgttaccgatattacgatcttggtcgtagcggcagatgacggggttatgcctcagactattgaagccatcaaccactcaaaagcagctaacgttccaatcatcgtagctattaacaagattgataaaccaggtgctaacccagaacgcgttatcggtgaattggcagagcatggtgtgatgtcaactgcttggggtggagattctgaatttgttgaaatttcggctaaattcaaccaaaatatcgaagaattgttggaaacagtccttcttgtggctgaaatccaagaactcaaagcagacccaacagttcgtgcgatcggtacggttatcgaagcgcgcttggataaaggaaaaggtgcggtcgcaacccttcttgtacaacaaggtaccttgaatgttcaagacccaatcgttgtcggaaataccttcggtcgtgtccgtgctatgaccaacgaccttggtcgtcgtgttaaagttgctggaccatcaacaccagtctctatcacaggtttgaacgaagcaccgatggcgggtgaccactttgccgtttacgaggatgaaaaatctgcgcgtgcagcaggtgaagagcgtgccaaacgtgccctcatgaaacaacgtcaagctacccaacgtgttagccttgaaaacctctttgatacccttaaagctggggaactcaaatctgttaatgttatcatcaaggctgatgtacaaggttctgttgaagccctttctgcctcacttcaaaagattgacgtggaaggtgtcaaagtgactatcgtccactcagcggtcggtgctatcaacgaatcagacgtgacccttgccgaagcttcaaatgcctttatcgttggtttcaacgtacgccctacaccacaagctcgtcaacaagcagaagctgacgatgtggaaatccgtcttcacagcattatctacaaggttatcgaagagatggaagaagctatgaaagggatgcttgatccagaatttgaagaaaaagttattggtgaagcggttatccgtgaaaccttcaaggtgtctaaagtgggaactatcggtggatttatggttatcaacggtaaggttgcccgtgactctaaagtccgtgttatccgtgatggtgtcgttatctatgatggtgaactcgcaagcttgaaacactataaagacgacgtgaaagaagtgacaaacggtcgtgaaggtggattgatgatcgacggctacaatgatattaagatggatgatgtgattgaggcgtatgtcatggaagaaatcaagagataa

SEQ ID NO: 477 - DNA, 912 bp, Streptococcus pneumoniae
cccataaaaatatacaggaggcctgataaaatggcaatcgtttcagcagaaaaatttgtccaagcagcccgtgacaacggttatgcagttggtggatttaacacaaacaaccttgagtggactcaagctatcttgcgcgcagcagaagctaaaaaagctccagttttgatccaaacttcaatgggtgctgctaaatacatgggtggttacaaagttgctcgcaacttgatcgctaaccttgttgaatcaatgggtatcactgtaccagtagctatccaccttgaccacggtcactacgaagatgcacttgagtgtatcgaagttggttatacttcaatcatgtttgacggttcacaccttccagttgaagaaaaccttaaattggctaaagaagttgttgaaaaagcacacgctaaaggtatctcagtagaagctgaagttggtactatcggtggtgaagaagatggaatcatcggtaaaggtgaattggctccaatcgaagacgctaaagcaatggttgaaactggtatcgacttcttggcagctggtatcggtaacatccacggtccttacccagtaaactgggaaggtcttgaccttgaccacttgcaaaaattgacagaagctcttccaggattcccaatcgtattgcacggtggatcaggtattcctgatgagcaaatccaagcagctatcaaacttggtgttgccaaagttaacgttaacacagaatgccaaatcgcattcgctaacgcaactcgtaaatttgctcgtgactacgaagcaaacgaagcagaatacgacaagaaaaaactcttcgacccacgtaaattcttggctgacggtgtaaaagctatccaagcatcggttgaagaacgtatcgacgtattcggttcagaaggtaaagcataa

SEQ ID NO: 478 - DNA, 468 bp, Streptococcus pneumoniae
aaatctctaattaccgccaaaaccacaaaggaggatttaaaaatggctaaaaaagtcgaaaaacttgtaaaattgcaaatccctgctggtaaagctacaccagctccaccggttggacctgctcttggtcaagctggtatcaacatcatgggattcacaaaagagttcaacgctcgtacagctgaccaagctggtatgatcattccagttgttatctcagtttacgaagataaatcatttactttcgttacgaaaacaccaccagctgctgttcttttgaaaaaagctgcaggtgttgaaaaaggatcaggtacacctaataaaactaaagttgctacagttactcgtgcacaagtacaagaaattgcagaaactaagatgccagatttgaacgcagcaaacgtagagtctgcaatgcgtatgatcgaaggtactgctcgttctatgggattcactgttgttgactaa

SEQ ID NO: 479 - DNA, 693 bp, Streptococcus pneumoniae
aaaatggctaaaaaaagcaaacaacttcgtgctgctcttgagaaaatcgacagcacaaaagcatacagtgtagaagaagctgtagcacttgcaaaagaaactaactttgcaaaatttgatgcaactgtagaagttgcttacaacttgaacatcgacgttaaaaaagctgaccaacaaatccgtggagcaatggtattgccaaacggtactggtaaaacttcacgtgttcttgttttcgcacgtggtgcaaaagctgaagaagcaaaagctgctggtgcagactttgttggtgaagatgaccttgttgctaaaatcaacgacggttggttggacttcgacgtagttatcgctacacctgatatgatggctcttgttggacgtcttggacgtgtccttggaccacgtaacttgatgccaaaccctaaaactggtactgtaacaatggatgttgctaaagcagttgaagagtctaaaggtggtaaaatcacttaccgtgctgaccgtgcaggtaacgttcaagcaatcatcggtaaagtatcatttgaagctgaaaaattggttgaaaactttaaagctttcaacgaaacaatccaaaaagcaaaaccagctacagctaaaggaacttacgtaacaaacttgactatcacaactactcaaggtgttggtatcaaagttgacgtaaactcactttaa

SEQ ID NO: 480 - DNA, 1866 bp, Streptococcus pneumoniae
attttgaatattatagaggaaatcatgacaaaattaagagaagatatccgtaacattgcgattatcgcccacgttgaccacggtaaaacaaccctggttgacgaattattgaaacaatcagaaacgcttgatgcacggactgaattggcagagcgtgctatggactcaaacgatatcgaaaaagagcgtggaattaccatccttgctaaaaatactgccgttgcttacaacggaactcgtatcaacattatggacacaccaggacacgcggactttggtggagaagttgagcgtatcatgaaaatggttgacggtgttgtcttggtcgtagatgcctatgaaggaaccatgccacaaactcgtttcgtattgaaaaaagccttggaacaagaccttgtcccaatcgtggttgttaacaaaatcgataagccatcagctcgtccagcagaagtagtggatgaagtcttggaacttttcatcgagcttggtgcagatgacgaccagcttgatttcccagtggtttatgcttcagcgatcaacggaacttcttcattgtcagatgatccagctgaccaagaagcgactatggcaccaatctttgacacgattatcgaccatatcccagctccagtagataactcagatgagcctttgcagttccaagtgtcacttttggactacaatgacttcgttggacgtatcggtatcggtcgtgtcttccgtggtacagttaaggttggggaccaagttaccctttctaaacttgacggtacaactaaaaacttccgtgttacaaaactcttcggtttctttggtttggaacgtcgtgaaatccaagaagccaaagcgggtgacttgattgccgtttcaggtatggaagacatctttgtcggtgaaaccatcactccgacagatgcagtagaagctcttccaatcctacacatcgatgagccaactcttcaaatgactttcttggtcaacaactcaccatttgctggtaaagaaggtaaatgggtaacttctcgtaaggtggaagaacgcttgcaggcagaattgcaaacagacgtttcccttcgtgttgacccaactgattcaccagataaatggactgtttcaggacgtggagaattgcacttgtcaatccttatcgaaacaatgcgtcgtgagggctatgaacttcaagtatctcgtccagaagttatcgtaaaagaaatcgacggtattaaatgtgaaccatttgaacgtgtacaaatcgacactccagaagaataccaagggtctgttatccaaagcctttctgaacgtaaaggtgaaatgttggatatgatttcaactggtaatggtcaaactcgtttggtcttccttgttccagcgcgtggtttgattggatactcaactgagttcttatcaatgactcgtggttacggtatcatgaaccataccttcgaccaatacttgccattgattccaggggaaattggtggacgtcaccgtggtgcccttgtttctatcgatgctggtaaggctacaacttactcaatcatgtctatcgaagaacgtggtacgatctttgtcaacccaggtactgaggtttatgaaggaatgatcatcggtgaaaactctcgtgaaaatgacttgacagttaacatcacgaaggcaaaacaaatgaccaacgttcgttcagctactaaggaccaaacagctgttatcaagacgcctcgtatcttgacacttgaagagtctcttgagttcttgaacgacgatgagtacatggaagtaacgcctgagtctatccgtttgcgtaaacaaatccttaacaaagcagagcgtgagaaagctaacaagaagaaaaaatcagctgaataa

SEQ ID NO: 481 - DNA, 1200 bp, Streptococcus pneumoniae
aaaaagagttattatagttgtatagtaaaaagcaaacgcttacttaatcgaggaggacagtttatgtcatacaaaacaagcaatgcagaaggtcatgtagacttcatcaatacctatgatttggagccaatggcgcaacaagttattcctaaagcagcatttggctatatcgctagtggggcggaagatactttcactttaagagagaatatccgtgcctttaaccacaagctcatcgttcctcatacactttgcaatgtagaaaatccaagtacagagattgaatttgcaggtgaaaaactatcttctccaatcattatggcacctgttgcggctcataaattggcaaatgaacagggggaagtggcgactgcgcgtggtgtgcatgagtttggttctctttatacaaccagttcttactctactgttgaccttccagagatttctgaagccctccaagggacacctcattggtttcaattttactttagtaaggatgacggtatcaaccgccacatcatggaccgtgtgaaggctgaaggttataaagcgattgtcttgacggcagatgctactgtaggggggaatcgtgaagtggataagcgtaatggttttgtcttcccagttggcatgccgattgttgaagaatacctgccagaaggtgctggtaaatcaatggactttgtttacaaatcagctaaacaacgcttgtctccacgcgatgtagaatttatcgctgaatactctggtcttcctgtgtatgtcaagggaccacaatgccgtgaggacgttgaacgttcgcttgctgcaggagcttctggtatctgggtaaccaaccacggtggtcgtcaaatcgacggtggaccagctgcctttgactcgcttcaagaagtggcagaagcagttgatagacgtgtgccgattgtctttgactctggtgttcgtcgtggtcaacacgtctttaaagccttggcatcaggagcagacttggttgctattggacgccctgtcatctatggcttggctctcggtggtagtgtcggtgtgcgtcaagtctttgaacacttgaatgcggaattgaagacagttatgcaattgtctggaactcagaccattgaagatgtcaaacacttcaagctccgtcacaatccatacaacccaaccttcccagttgaccctcgtgacttaaaattgtattga

SEQ ID NO: 482 - DNA, 1011 bp, Streptococcus pneumoniae
aaaagagttcaattcgaactctttttttgctataatgaggggagaaaaatcagacaggagatcgacatgtcagaaccattatttttacaatcagttatgcaagaaaaaatctggggtggagccaagctacgtgatgagtttggctacgacatcccaagtgaaaaaatcggagaatattgggccatctcagcccatccaaatggagtctctaaagttgccaatggtcgttacgagggaacagatcttgctactttgtatgcggaacaccgtgaattatttggcaatcgtccagaacctgtatttccacttttgaccaagatcctcgatgccaacgactggctcagtgtccaagttcacccagacgatgcttatggactcgagcatgaaggcgaactcggaaaaacagaatgctggtacattatcgcagcggatgaaggttcagagattatctacggtcacaatgccaagtcaaaagaagaactccgccagcaaatcgaggacaagaactgggatgacttgttgaccaaagtccctgttaaggctggagatttcttctatgtaccaagcgggactatgcacgctatcggggcgggtatcttaatccttgaaacccagcagtctagcgataccacctatcgcgtctatgactttgaccgcaaggatgacaaaggcaacttgcgtgaacttcatcttgaaaaatccatcgatgtcttgaacattggtgagccagcaaatagccgtcctgtaactgttaaagcagatgatttgcgttccactctccttgtatctaatgatttcttcgcagtttacaagtgggaaattactggaaaagttgactttgaaaagacagctgactacagcttattgagtgtcttggctggtcaaggtcagctaactgttgacgggaaaaattatccaattcaaaaaggcagccactttatcctaccaagtgatgttgaagcttggactctggaagggcaaggtttggaattgattgttagccatccataa

SEQ ID NO: 483 - DNA, 864 bp, Streptococcus pneumoniae
caaagatggagaatttctatgacttggaagattattgctgactctggttgtgattatcgtcaactgccaacaccagctattaacacaacctttgtaagtgtccccttaaccattcaagtagctgatcaggtctttgttgatgacgccagtctcgatattgaccaaatgatggaaaccatgtatgcaactgcagaagcttcaaaatcggcttgtccaagcccagatgactatttgcgagcatttgaaggtgccaaaaacattttcctagtaaccatcacaggtaccctttctggcagtcacaatagtgctcaactagcaaagaatatttatctggaagaccatcctgacactaagattcatgtgattgatagtttatctgctggtggtgaagttgacctactcgtagaaaaattgaatgacttgattgaccagggcttgtcttttgaagaagtggttgaagctatcaccgcctatcaagaaaaaactaagttgctctttgtcctagccaaagtcgataacttggtgaagaacggccgtttgagcaagcttatcggtacggtcgttggccttctcaacattcgtatggtcggaaaagctagtgaaactgggactctcgaattgctacaaaaagcaaggggatcaaagaaatcagttcaagctgcctatgatgagttagtaaaagctggatatgctggtggccgtattgtcatggcccaacgcaataacgaaaaatgttgtcaacagctctcagagcgaatccgtgaaaccttcccacaagcggatattaaaattctaccaacctctggtctctgcagtttctatgcagaagagggcggtttgctgatgggctatgaaattgattaa

SEQ ID NO: 484 - DNA, 681 bp, Streptococcus pneumoniae
accgttttttggtataataagaagaataaattgaaagaaggaattccaaaaatgggaaaaattgaagttattaatcacccactgattcaacacaaattgtcaatcttgcgtcgtacagatacttctacaaaagcttttcgtgagctagtagatgagattgcaatgttgatggggtatgaagtacttcgtgatcttccactagaagatgtggaaatcgaaacaccaattacaaaaacagttcaaaaacaattggcaggtaagaaattggccatcgtcccaatcttgcgtgcaggtatcgggatggttgatggtctcttgaacttggttccagctgctaaagttggccacatcggtatgtaccgtgatgaagaaacacttcaaccagttgaatacttggtgaaattgcctgaggacattgaccaacgtcaaatttttgtagtagacccaatgttggcaacaggtggctcagcaatcttggctgttgattctcttaaaaaacgtggcgcatcaaatatcaaatttgtctgccttgtatctgctccagagggtgtaaaagcccttcaagaagctcatccagatgtagaaatctttacagcagccttggatgaacgtttgaacgaacacggttatatcgttccaggtcttggagatgctggagaccgcttgttcggtacaaaataa

SEQ ID NO: 485 - DNA, 951 bp, Streptococcus pneumoniae
aatcaatgccgcagtggtatcgatggaaaacaaatcgaagtagtcgataaagataataagtctgaaacagctgaggctgcttcagttacaactaaccttgtaacccaatctaaagtatcagcagtcgtaggacctgcgacatctggtgcgactgcagctgcggtagcgaacgctacaaaagcaggtgttccattgatctcaccaagtgcgactcaagatggattgactaaaggtcaagattacctctttattggaactttccaagatagcttccaaggaaaaattatctcaaactatgtttctgaaaaattaaatgctaagaaagttgttctttacactgacaatgccagtgactatgctaaagggattgcaaaatctttccgcgagtcatacaagggtgaaatcgttgcagatgaaactttcgtagcaggtgacacagacttccaagcagcccttacaaaaatgaaagggaaagactttgatgctatcgttgttcctggttactataatgaggctggtaaaattgtaaaccaagcgcgtggcatgggaattgacaaaccaatcgttggtggtgatggattcaacggtgaggagtttgtacaacaagcaactgctgaaaaagcatcaaacatctactttatctcaggcttctcaactactgtagaagtttcagctaaagctaaagccttccttgacgcttaccgtgctaagtacaatgaagagccttcaacatttgcagccttggcttatgattcagttcaccttgtagcaaacgcagcaaaaggtgctaaaaattcaggtgaaatcaagaataaccttgctaaaacaaaagattttgaaggtgtaactggtcaaacaagcttcgatgcagaccacaacacagtcaaaactgcttacatgatgaccatgaacaatggtaaagttgaagcagcagaagttgtaaaaccataa

SEQ ID NO: 486 - DNA, 1218 bp, Streptococcus pneumoniae
caatattttttaaggggggacatttttatgtcagagcgtaaattattcacgtctgaatctgtatctgaggggcatccggataagattgcagaccaaatttcagatgcgattttggatgctattttagcaaaggatccagaggcgcacgttgctgctgaaacagctgtatatactggttctgtccacgtttttggtgaaatttctacaaatgcctatgtggatattaaccgtgtggttcgtgataccattgcagagattggttataccaatacagaatatggattttctgctgagacggtgggagtacacccatctttggtggaacaatctcctgacatcgctcaaggtgttaacgaagccttggaggttcgtggaaatgctgatcaagatccactggacttgattggagcaggtgaccaagggctcatgtttggatttgcagtagatgaaacagaagagcttatgccattgccaattgcactcagtcataaattggttcgtcgtctggcagaacttcgtaagtctggagaaattagctatctccgtccagatgcaaaatcacaagttacagttgagtacgatgaaaatgaccgtccggtacgtgtagatacagtcgttatttctactcagcatgatccagaggccactaatgaacaaatccatcaagatgtgattgacaaggtcatcaaagaagttattccatcttcttatcttgatgataagacaaaattctttatcaatccgacaggtcgttttgtaatcggtggtcctcaaggggactcaggtttgactggtcgtaagattattgtagatacttatggtggctactctcgtcatggtggtggtgccttctctggtaaagatgcgactaaggtggatcgttcagcctcttatgcggctcgctatattgccaagaatatcgttgcagcagaccttgctaagaaggcagaagtgcagttggcctatgctatcggtgttgcgcaacctgtttctgttcgtatcgatactttcggtacaggaacagtagctgaaagtcaacttgaaaaagcggctcgtcaaatctttgaccttcgccctgcagggattatccaaatgctggacctcaagcgtccaatttaccgtcaaacatcggcttacggtcacatgggacgtacagatattgatcttccatgggaacgtttggataaggtagatgctttgaaagaagcagtaaaataa

SEQ ID NO: 487 - DNA, 291 bp, Streptococcus pneumoniae
agaaatgagactttaaaaatggcagttaaaatccgtttgactcgtatgggttctaagaaaaaacctttctaccgtatcaacgtagcagattcacgttcaccacgtgacggacgtttcatcgaaacagttggaacttacaacccacttgttgctgaaaaccaagtaactttgaaagaagaccgcgttcttgcatggttggctaatggagctcaaccttcagacacagtacgtaacatcctttcaaaagaaggcgtattgaaaaaattccacgattctaaattttcaaaataa

SEQ ID NO: 488 - DNA, 414 bp, Streptococcus pneumoniae
acattatcaactgacagtagaagaagaaaaaatgctggcagaaatcaaagaaaacaaagaataaaggagaaacctatgcaagtaatcaaacgtaatggcgaaattgctgaatttaatccagataagatttaccaagccatcttgaaggcagcccaaactgtttatgttttgacagatgatttgcgtcaaaatcttgctcaagtcactaagaaggtagttttggatttacaagaagccaaggtggaacgtgcgactatcagtatgattcaatctatggttgaacatcgtttattgggcgcaggttacattaccattgcagaacactacatttcctatcgtttacaacgtgacttggaaagaagtggttatggagatcatatcgcagttcatttacattttgaacaaattcgctaa

SEQ ID NO: 489 - DNA, 2268 bp, Streptococcus pneumoniae
ggtagatgtatgctttgtcaaaactgtaaaattaacgactcaacaattcatctttacaccaatctcaatggaaaacaaaaacaaattgacctctgtcaaaactgctataagattatcaaaacagatcctaacaatagcctcttcaaaggtatgacggatctgaacaatcgtgacttcgatccctttggtgatttcttcaatgatctaaacaatttcagaccttctagcaatactcctcctattcccccaacccaatcaggtggaggttacggtggaaacggcggttatggttcccaaaatcgtggatctgctcaaactccgccacctagccaagaaaaaggcctgctggaagaatttggtattaatgtaactgaaattgcccgtcgtggagacattgaccccgttattgggcgcgacgatgagattatccgtgtcatcgagattctcaatcgtagaaccaagaataatcctgtccttatcggtgaacctggtgtcggaaaaacggccgttgtcgaaggtctagctcagaaaattgtcgatggcgatgtgccacataaactccaaggtaaacaagtcatccgtctggatgtggttagcttagttcaaggaacggggattcgaggacaatttgaagaacgcatgcaaaaactcatggaagaaattcgcaaacgtgaagacatcatcctctttatcgatgaaatccatgaaattgttggtgctggttctgcgagtgatggtaatatggacgcaggaaatatcctcaagccagcccttgctcgtggagaactgcaactagtcggtgctactaccctcaatgaataccgtatcattgaaaaggatgctgccctcgagcgtcgtatgcagcctgttaaagtcgatgaaccaacggtggacgaaacaatcactattctcaaagggattcaaaagaaatacgaagattaccaccacgttcaatatacagatgctgcgattgaagcagctgcaactctttccaatcgctacatccaagatcgcttcttgcctgacaaggccattgacctcctagatgaagctggttctaagatgaacttgaccttgaattttgtggatcctaaagtaattgatcagcgcttgattgaggctgaaaatctcaagtctcaagctacacgagaagaagattttgagaaggcggcctacttccgcgaccagattgccaagtataaggaaatgcaaaagaaaaagatcacagaccaggatactcctagcatcagcgagaaaactattgagcacattatcgagcagaaaaccaatatccctgttggtgatttgaaagagaaagaacaatctcaactcatccatctagccgaagatctcaagtctcatgttattggtcaagatgatgcagtcgataagattgccaaggctattcgccgtaatcgtgtcggacttggtacccctaaccgcccaatcggaagcttcctcttcgttgggccaactggtgtcggtaagacagaactttccaaacaactggctatcgaactttttggttctgctgatagtatgattcgctttgatatgagtgaatacatggaaaaacatagtgtggctaagttggtcggcgctcctccaggttatgttggctatgatgaggctggtcaattaactgaaaaagttcgccacaatccatattctctcatccttctcgatgaagtggaaaaagctcacccagatgttatgcacatgtttcttcaagtcttggacgatggtcgtttgacagacgggcaaggacgcaccgttagcttcaaggatgccatcattatcatgacctcaaatgcaggtacaggaaagaccgaagctagcgttggatttggtgctgctagagaaggacgtaccaattctgtcctcggtgaactcggtaacttctttagcccagagtttatgaaccgttttgatggcattatcgaatttaaggctctcagcaaggataacctccttcagattgtcgagctcatgctagcagatgttaacaagcgcctctctagcaacaacattcgtttggatgtaactgataaggtcaaggaaaagttggttgacctaggttatgatccaaaaatgggagcacgcccacttcgtcggactattcaagactatattgaggacacaatcactgactactaccttgaaaatccaagcgaaaaagatctcaaagcagttatgactagcaagggaaacattcagattaaatctgccaaaaaagctgaagttaaaagttctgaaaaagaaaaataa

SEQ ID NO: 490 - DNA, 1203 bp, Streptococcus pneumoniae
atgaacgaatttgaagatttgctaaatagcgttagtcaagttgagactggtgatgttgttagtgctgaagtattgacagttgatgcgactcaagctaacgttgcaatctctggaactggtgttgaaggtgtcttgactcttcgcgaattgacaaacgatcgtgatgcagatatcaatgactttgttaaagtaggagaagtattggatgttcttgtacttcgtcaagtagttggtaaagatactgatacagttacataccttgtatctaaaaaacgccttgaagctcgcaaagcatgggacaaacttgttggtcgcgaagaagaagttgttactgttaaaggaacgcgtgccgttaaaggtggactttcagtagaatttgaaggtgttcgtggatttatcccagcttcaatgttggatactcgtttcgtacgtaacgctgagcgttttgtaggtcaagaatttgatactaaaatcaaagaagttaacgctaaagaaaaccgcttcatcctttcacgtcgtgaagttgttgaagcagctactgcagcagctcgcgctgaagtattcggtaaattggctgttggtgatgttgtaactggtaaagttgctcgtatcacaagcttcggcgctttcgtcgaccttggtggtgttgacggattggttcacttgactgaattgtcacatgaacgtaatgtatcaccaaaatcagttgtaactgttggtgaagaaattgaagtgaaaatccttgatcttaacgaagaagaaggacgtgtatcactttcacttaaagcaacagtaccaggaccatgggatggcgttgagcaaaaattggctaaaggtgatgtagtagaaggaacagttaaacgtttgactgacttcggtgcatttgttgaagtattgccaggtatcgatggacttgttcacgtatcacaaatttcacacaaacggattgaaaatccaaaagaagctcttaaagttggtcaagaagttcaagttaaagttcttgaagttaacgcagatgcagaacgcgtgtcactttctattaaagctcttgaagaacgtccagcccaagaagaaggacaaaaagaagaaaaacgtgctgctcgtccacgtcgtccaagacgtcaagaaaagcgtgatttcgaacttccagaaacacaaacaggattttcaatggctgatttgtttggtgatatcgaactttaa

SEQ ID NO: 491 - DNA, 1443 bp, Streptococcus pneumoniae
attattagaaatgaagaaagaaaggatactatggctgaagaaagagtagaaccaaaaccaattgaccttggtgaatataaatttggtttccatgacgatgtagagcctgtcttatcgacaggaaaaggactcaacgaaggtgttattcgtgaattatctgctgctaagggtgagcctgagtggatgttggagttccgtttgaagtcttatgaaaccttcaaaaaaatgcccatgcaaacttggggagcagacttgtcagagattgactttgatgacttaatctactaccaaaaaccatctgacaaaccagcccgttcttgggatgatgtacctgaaaagattaaagaaacctttgaacgtatcgggattccagaagctgaacgtgcttatttagcaggggcttctgcccagtacgagtcagaagtggtttaccacaacatgaaggaagagttccaaaaattaggtattatctttacagatacagattccgcactcaaggaatacccagacttatttaaacaatactttgcgaagttggtaccgccgacagataacaagttggcagccctcaactcagcagtatggtcgggtggaacttttatctacgtgccaaaaggtgtcaaggtagatattccacttcaaacttatttccgtatcaataacgaaaatataggtcagttcgaacgtaccttgattatcgttgatgagggagcaagcgtctactacgtagaaggatgtacagcaccaacatattcaagcaatagcttacacgctgccattgtagaaatttttgctttggacggagcttatatgcgttatacaactatccaaaactggtctgataacgtctataacttggtaacaaagcgtgctaaggctcaaaaggatgccactgttgagtggattgatggaaacttgggtgccaaaacgactatgaaatatccatctgtttaccttgatggagaaggagcgcgtggtaccatgctctctatcgcctttgctaatgcagggcaacaccaagacacgggtgctaagatgattcacaatgctccacataccagctcgtctattgtgtctaaatccatcgctaaaggtggaggaaaggttgactaccgtggacaagtcacctttaacaagaactctaagaaatctgtttcccacattgaatgtgataccattatcatggatgacttgtcagcatcagatactattccatttaatgaaattcacaactcgcaagtggctttggaacacgaagccaaagtatctaagatttcagaagagcaattgtattatctcatgagccgtggattgtcagaatctgaggcaactgaaatgattgtcatgggatttgtagaaccctttacaaaagaacttccaatggaatacgcagttgagctgaaccgcttgattagctatgaaatggagggatcagttggataa

SEQ ID NO: 492 - DNA, 1254 bp, Streptococcus pneumoniae
aataagactactatgaaaaaaatatttttaactttgttaactgtctctcttttagggggtgcttctactgctgttgctcaagattttaccattgccgctaaacatgcgattgctgttgaggcaaatactggtaaaattctctatgagaaggatgcaacgcaacctgtcgaaattgcttccataacaaaattgattactgtttatctggtctatgaagctttggaaaacggaagtattaccctctccactcctgtagatatttctgattatccttatcaattgacgacaaattctgaagccagtaatattcctatggaggcccgtaattatactgtcgaagagttgcttgaagcaactctggtatctagtgccaacagcgccgctattgccctagctgagaaaattgctggctcagaaaaagatttcgtcgatatgatgcgggcaaaactcttggaatggggaattcaggatgccactgttgtcaatacgacaggtcttaacaatgaaactctaggggataacatttacccaggttctaaaaaagatgaggaaaataagcttagtgcttatgatgtcgctatcgttgctcgcaacctcatcaaaaaatacccacaagtcttagaaatcaccaaaaaaccttcttctacttttgctgggatgacaatcacttcaaccaactacatgttagaaggtatgcctgcttaccgtggtggttttgatgggctaaaaacaggaacaacagataaggctggagagtcttttgttggtactactgtcgaaaaaggcatgagagtcatcacagttgttttaaatgcagatcatcaagacaataatccttacgctcgatttacagctacatcttccctaatggattatatttcttctacatttacacttcgcaaaatcgttcaacaaggcgatgcctatcaagatagcaaagcccctgtacaagatggaaaagaagatacagtaactgcagtggctccagaggatatctatctaatcgaacgtgttgggaatcaatcttcccaatctgttcaattcacacctgattccaaagcaatcccagcaccacttgaagctggaacagtggttggccatttgacttatgaagacaaggacttgattggtcaaggttacatcaccacagagcgccctagtttcgaaatggtagcagacaagaaaattgaaaaagccttcttcttaaaagtttggtggaatcagtttgtccgctttgttaacgagaaattataa

SEQ ID NO: 493 - DNA, 1074 bp, Streptococcus pneumoniae
aagaattttcaacgtaaatgtggtataatcagtaagaatgttaaaagaaaaaggagcataaccaatatgaaacgtattgctgttttgactagtggtggagacgcccctggtatgaacgctgccatccgtgcagttgttcgtcaagcaatttcagaaggaatggaagtttttggtatctatgacggatatgctggtatggttgccggtgaaattcatcccctagatgcagcttcagtaggggacatcatttctcgtggtggtactttccttcactcagctcgttacccagagttcgctcaacttgaagggcaacttaaagggattgagcaattgaaaaaacacggaattgaaggtgtagttgttatcggtggtgacggatcttaccacggcgctatgcgtttgactgaacatggcttcccagctattggtcttccaggtacaatcgataacgatatcgttggtactgactttacaatcggttttgacacagcggttactactgccatggacgctatcgataagattcgtgatacatcatcaagtcaccgtcgtacttttgtaatcgaagttatgggacgtaacgctggtgatatcgctctttgggctggtattgcaactggtgctgatgaaatcatcatccctgaagcaggcttcaagatggaagatatcgtagcaagcatcaaagctggttatgaatgtggtaaaaaacacaatattatcgtcttagctgaaggtgtgatgtcagcggctgaatttggtcaaaaacttaaagaagctggagatacaagcgaccttcgtgtaacagaacttggacatattcaacgtggtggttctccaactgcgcgtgaccgtgttttggcgtcacgtatgggtgcacatgctgttaaacttcttaaagaaggtatcggtggtgttgcggttggtattcgtaacgaaaaaatggttgaaaatccaattcttggtactgcagaagaaggggcattgtttagccttactgcagaaggtaagattgtggttaacaacccacacaaagccgatattgagctatctagcttgaataagagcttgtcataa

SEQ ID NO: 494 - DNA, 1545 bp, Streptococcus pneumoniae
gaccaaaaaggtcatatatataaaggagtcacaaaaatcatgaacaaacgtgtaaaaatcgttgcaactttgggtcctgcggtagaaatccgtggtggtaaaaaattcggtgaggacggatactggggtgaaaaacttgatgttgaagcttcagctaaaaacattgctaaattgattgaagctggtgctaacacattccgattcaacttctcacacggcgaccaccaagaacaaggtgagcgtatggcaactgttaaacttgcggaaaaaattgcaggtaaaaaagttggtttccttcttgatacaaaaggacctgaaatccgtacagaattgttcgaaggtgaagctaaagaatattcatacaaaactggtgaaaaaattcgtgttgcaactaaacaaggaatcaaatcaactcgtgaagtgattgcgttgaacgttgctggtgctcttgatatctatgatgatgttgaagttggtcgtcaagttttggttgacgatggtaaacttggtcttcgtgtggttgctaaagatgatgcaactcgtgaatttgaagttgaagttgaaaacgatggtatcatcgctaaacaaaaaggtgtgaacatccctaacactaaaattcctttcccagctcttgctgaacgcgataacgacgatatccgtttcggtcttgaacaaggtatcaacttcatcgcaatttcattcgtacgtactgcaaaagatgtgaacgaagttcgtgcaatctgtgaagaaactggaaacggacatgttcaattgttcgctaaaatcgaaaaccaacaaggtatcgataacttagatgaaatcatcgaagcagctgatggtattatgattgctcgtggtgatatgggtatcgaagtaccgttcgaaatggttccagtttatcaaaaaatgattatcaagaaagtcaatgctgcaggtaaagttgttatcactgcaacaaacatgcttgaaacaatgactgaaaaaccacgtgcaactcgttcagaagtatcagatgtattcaacgctgttatcgacggaactgacgctacaatgttgtcaggcgagtctgcaaacggtaaatacccactcgagtcagtaactacaatggctacaatcgacaagaacgctcaagctcttcttaatgaatacggacgtcttgattcagattcatttgagcgtaactctaagacagaagtaatggcttctgctgttaaagatgctactagctcaatggatatcaaattggttgtaactcttactaagacaggtcatactgcacgtttgatttctaaataccgtccaaatgctgacatcttagcattgacatttgacgaattgacagaacgtggcttgatgttgaactggggtgttatcccaatgttgacagatgctccatcttcaactgacgatatgttcgaaatcgctgaacgtaaagcggtagaagcaggtctcgttgagtcaggcgatgatatcgttatcgttgctggtgtgccagtaggagaagctgttcgcacaaacacaatgcgtatccgcacagtacgttaa

SEQ ID NO: 495 - DNA, 1488 bp, Streptococcus pneumoniae
aaggagtatgttttgaaagagttagatcaaaaccaagccccaatttatgaggccttggtgaagttacgcaagaaaaggattgttccctttgatgttccaggtcacaagcgtggacggggaaatccagaacttgtcgaactcttaggagaaaaatgtgtaggcattgatgtcaattcgatgaaacctttggataatttaggccatcctatttcgattattcgtgatgcagaggagctggctgcagatgcttttggagctagccatgcctttctaatgattggtggaacaacttcatcggtgcagactatgattctggcaacctgcaaggcaggagataagattattctgccacgaaatgtccataaatctgctatcaatgcgttggttctatgtggtgccattcccatctatatcgagatgagtgtagatcctaagattggtatcgctttaggtcttgaaaatgaccgagtagcacaggccataaaggaccatccagatgctaaggctatcctaatcaacaatcctacttactacggcatctgttcagacctaaaggggttgacagaaatggctcatgaagctggcatgatggttttagtagatgaagcccacggagcgcatttgcatttcactgataaacttccaatttctgctatggatgcaggggctgatatggcagcagtttccatgcataagtctggtgggagtttgacccaaagctccattttacttatcggggagcagatgaattctgaatacgttcgtcagataattaacctgacccagtctacatctgcctcttacttgttgatggctagtttggatatttcacgtcgcaacttggcccttcgtggtaaagagtcgtttgagaaagtcattgagctatctgagtatgcccgccgtgaaatcaatgctatcggtggctactatgcctactcaaaagagttaatagacggtgtttcggtttgcgattttgacgtaactaagctgtcagtttacactcagggtattggcttaacaggtatcgaggtttatgacctcttgcgagacgaatacgacattcagatcgagtttggtgatatcggcaatatcttggcctatatttccatcggcgaccgcatccaagacatcgagcgcttggttggtgctctggctgatattaagagactctattcaagagatggaaaagatttgatagcaggagaatatattcagcccgagttagtgctgtctccgcaagaagccttctattcagaaagaaaaagtttaactttggatgattctgttggacaggtctgtggagaatttgttatgtgttaccctccaggtattcctatcttggctcctggtgaacgcattacacgagaaattgtcgactatatccaattcgccaaggaacgtggttgctccctccaagggacggaagatccagaggtcaatcatatcaacgttattaagagaaagacaaactataagaaaagtcaatag

SEQ ID NO: 496 - DNA, 861 bp, Streptococcus pneumoniae
atggatttatggttttctgaagttcatactccagatgtcaaattgtctctgagaacagccaagcaactttacgctggaaaaagtgaatggcaggatatcgaagtcttggatacgccagcttttgggaaaatactgattttaaatggccatgtcttgttctcagatgcggatgatttcgtctacaatgaaatgaccgttcacgttcccatggctgtccacccaaatccaaagaaagtattggttattgggggtggtgacggcggtgttgcccaagtattaaccctctatcctgaactggagcaaattgatattgtggaaccggatgagatgttggtcgaggtctgtcgtgagtatttcccagactttgctgcagggctagatgatcctcgtgttaccatttactaccaaaatgggctacgctttttgcgaaactgcgaagatgattacgatattatcatcaacgatgcgacagatccatttggccatacggaaggactctttaccaaggaattctacggcaatagttatcgagctctgaaggaagacggcatcatgatttaccagcatgggagtcccttctttgacgaggatgagtcggcctgccgaagcatgcaccgcaaggtcaatcaagcctttccaatcagtcgggtttatcaggcccatattccaactagcccagctggctattggttgtttggatttgcatcgaaaaaataccaccctgtcaaagattttgacaaggaaggctggaaaaaacgccagcttttcacagaatactacactgcaaacttacacgtgggagcctttatgttgcccaagtatgttgaggacattttagaagaagaggaaggaaaaaaatga

SEQ ID NO: 497 - DNA, 885 bp, Streptococcus pneumoniae
gagaaaaagatgagaaatgtaagagttgcaaccattcagatgcaatgcgctaaggatgtggcaacaaatatccaaaccgcagagcgtttagtacgtcaggctgctgagcaaggagcccaaattattctcttgcccgagttgtttgaacatccctatttctgtcaggaacgtcagtatgactactaccagtatgcccaatctgtagcggaaaatactgccattcagcattttaaggtgattgctaaggaactacaagttgttttaccaatcagtttctatgaaaaagatggtaatgtcttgtataactctattgccgtcattgatgcagatggggaagtgctgggcgtttatcgaaagacccatataccagatgaccattattatcaagaaaaattctatttcacgcctggtaacactggtttcaaggtctggaatactcgctatgctaagattggtatcggtatctgttgggatcaatggttccctgaaacagcgcgctgtcttgcattgaatggtgctgaattgctcttttatcctacagctatcggttcagagccaattttggatacagatagttgtggtcactggcaacgtactatgcaagggcacgcagcagcgaatattgttccagtcatcgcagccaatcgttatggtttagaggaggttactcctagtgaggaaaatggcggacagagctccagtcttgacttctacggttcctcctttatgacggatgaaacaggagctattctagaacgagctgaaagacaagaagaagctgttctgttagctacttatgacctagacaagggagcaagtgaacgcctaaactggggcttgtttcgagatagaagaccagaaatgtatagacaaattacagattag

SEQ ID NO: 498 - DNA, 363 bp, Streptococcus pneumoniae
aacatggcacgtgttaaaggtggcgttgtatcacgcaaacgtcgtaaacgtattcttaaattagcaaaaggttactatggagctaaacacatcttgttccgtactgcaaaagaacaagtaatgaactcttactactatgcataccgtgaccgtcgtcagaaaaaacgtgacttccgcaaattgtggattactcgtatcaatgcggcagctcgtatgaacggactttcatactcacaattgatgcatggtttgaaattggctgagatcgaagttaaccgtaaaatgcttgctgacttggctgttaacgatgcagtagctttcacagctcttgcagatgcagctaaagcaaaacttggtaaataa

SEQ ID NO: 499 - DNA, 555 bp, Streptococcus pneumoniae
gagcctatcatggagtttgaagaaaaaacgcttagccgaaaagaaatctatcaaggaccaatatttaaactggtccaagatcaggttgaattaccagaaggcaagggaactgcccaacgggatttgattttccacaatggggctgtctgtgttttagcagtaacggatgaacaaaaacttatcttggtcaagcagtaccgcaaagctatcgaggctgtctcttacgaaattccagccggaaaattggaagtaggagaaaacacagcccctgtggcagctgcccttcgtgaattagaggaagaaacagcctatacagggaaattagaactcttgtacgatttttattcagctattggcttttgtaatgagaagttaaaactatatttagcaagcgatttgacaaaagtggaaaatccgcgtccgcaggatgaggatgaaaccttggaagtccttgaagtgagcttagaagaagcgaaagaattaatccaatcaggtcatatctgtgatgccaagacaattatggctgttcagtattgggagttgcagaaaaaatag

SEQ ID NO: 500 - DNA, 585 bp, Streptococcus pneumoniae
ctggaatttttgaataaaggaggacaaatgaaaaaagtaatgtttgctggcttaagtctcttgtcattagttgtattgatggcctgtggtgaggaagaaactaaaaagactcaagcagcacaacagccaaaacaacaaacgactgtacaacaaattgctgttggaaaagatgctccagacttcacattgcaatccatggatggcaaagaagttaagttatctgattttaagggtaaaaaggtttacttgaagttttgggcttcatggtgtggtccatgcaagaaaagtatgccagagttgatggaactagcggcgaaaccagatcgtgatttcgaaattcttactgtcattgcaccaggaattcaaggtgaaaaaactgttgagcaattcccacaatggttccaggaacaaggatataaggatatcccagttctttatgataccaaagcaaccaccttccaagcttatcaaattcgaagcattcctacagaatatttaattgatagccaaggaaagattggaaagattcaatttggtgctatcagtaatgcggatgcagaagcagcatttaaagaaatgaactag

SEQ ID NO: 501 - DNA, 1269 bp, Streptococcus pneumoniae
aggagaagacctatgatttttgacaaagatgattttaaagcatatgatgctgatctctggaatgctattgccaaagaagaagaacgccaacaaaataatatcgagttaattgcttcggaaaacgtagtttccaaggctgttatggcagctcaagggtctatcttgacaaataaatatgccgagggttacccaggacgccgttattatggtggaactgatgtagtagacgttgtagagactcttgctattgaacgcgcaaaagaaattttcggtgctaaatttgccaatgttcaaccacattcaggaagccaagctaactgtgcggcttacatgtccttgattgagccaggtgatacggttatgggaatggatttggcatcaggtggtcatttgactcatggggctcctgttagcttctctggtcaaacctacaactttgtttcttatagtgttgatcctaaaacggaactcttagactttgatgctatcttgaaacaagcccaagaagtaaaaccaaaactgattgtagctggtgcttcagcctattctcaaattatcgatttttcaaaattccgtgaaatcgcagatgctgtcggtgcgaagctcatggtggacatggcccatatcgctggcttggttgcggctggccttcatccaagcccagttccatacgctcatatcacaacaacaacgacccacaaaacccttcgtggacctcgtggtggtttgattttgaccaatgacgaagaacttgctaaaaaaatcaattcagctattttcccaggtattcagggcggtcctttagagcatgttgtggcggctaaggcagtttccttcaaagaagttttggatccagccttcaaggaatatgctgccaatgtaattaagaacagcaaggctatggcagatgtcttcttgcaagaccctgatttccgtattatttcaggtggaactgaaaaccatctcttccttgttgatgtgactaaagttgtagaaaacggcaaagttgctcaaaacttgttggatgaagtcaatattaccttaaataaaaactcaatcccttacgaaagcttgtcaccattcaagacaagtgggattcgtatcggagcagcagccattactgcacgtggatttggtgaagaagaaagtcgcaaagtggctgaactcatcattaaaacccttaagaattcagaaaatgaggctgtattagaagaagtgagaagtgcagtcaaagaattgacagatgccttcccattatacgaggactaa

SEQ ID NO: 502 - DNA, 1035 bp, Streptococcus pneumoniae
ggagtttttatgaaaaacaaattttttctaatagctattttagctatgtgtatagtttttagcgcttgttcttctaattctgttaaaaatgaagaaaatacttctaaagagcatgcgcctgataaaatagttttagatcatgctttcggtcaaactatattagataaaaaacctgaaagagttgcaactattgcttggggaaatcatgatgtagcattagctttaggaatagttcctgttggattttcaaaagcaaattacggtgtaagtgctgataaaggagttttaccatggacagaagaaaaaatcaaagaactaaatggtaaagctaacctatttgacgatttggatggacttaactttgaagcaatatcaaattctaaaccagatgttatcttagcaggttattctggtataactaaagaagattatgacactctatcaaaaattgctcctgtagcagcatacaaatctaaaccttggcaaactttatggagagatatgattaaaattgattcaaaagccttaggtatggaaaaagaaggtgatgagttaatcaaaaatactgaagctcgtatatccaaagaattagaaaaacatccagaaatcaaaggaaaaatcaaaggaaaaaaagtattatttactatgattaatgctgcagatacatcaaaattctggatttatactagcaaagatccaagagcaaattatttaacagatttaggtctagttttccctgaatcattaaaagaatttgagagtgaagatagttttgcaaaggaaatttctgcagaagaagcaaataagataaatgatgctgatgtaatcataacttatggtgatgataaaactcttgaagctttacaaaaagatcctcttttaggtaaaataaatgcaattaaaaatggtgccgttgctgtaattccagataatacaccgttagcagcctcatgcactccaacaccactttcaataaactatactattgaagaatacctaaatcttttaggaaatgcatgcaaaaatgcgaaataa

SEQ ID NO: 503 - DNA, 2700 bp, Streptococcus pneumoniae
tttatgtctcttcaaaaattagaaaattatagtaataaaagtgttgtgcaagaagaagtcttgattctaacagaattactggaagatattactaaaaatatgcttgccccagagacctttgaaaaaataatacagttgaaagaattatcaacgcaggaagattatcaaggtctaaaccgtctagtgactagcttatcaaatgatgaaatggtctatatttcacgctatttctctatcttgcctcttttgattaatatttcagaggatgtggatttagcttatgaaatcaatcatcaaaataatattgatcaggactatttaggtaaattatctacaacgattaaattggtagcagaaaaggaaaatgccgttgagatcctagaacacttgaatgttgtccctgttttgacagcccatccaacacaagtgcaacgcaaaagtatgttggatttaacaaatcatattcatagtcttttgcgtaaataccgtgatgttaagttggggttgatcaataaagataaatggtacaatgatttgcgtcgttacatcgaaattatcatgcagacagacatgattcgtgagaaaaaattaaaagtgactaacgaaatcacgaatgctatggaatattataacagctcctttttgaaagctgtacctcatttgacgacggagtataagcgcttagcgcaagcgcatggtctgaatttaaaacaggctaaaccaatcaccatgggtatgtggataggtggtgaccgtgatggaaatccatttgttacagcaaagaccttgaagcagtctgcactcactcagtgtgaagtcatcatgaactactatgataaaaagatttaccaactttatcgtgaattttctctttcaactagcattgtcaacgtcagcaagcaagtcagagaaatggctcgtcaatccaaggataactcgatttaccgcgaaaaagagctttaccgtcgtgccttgtttgatattcaatcaaaaattcaggcaactaaaacctatctgattgaggatgaagaagttgggactcgttatgaaaccgccaatgatttctacaaggatttgattgccattcgagattctctactagaaaataagggcgagtccttgatttcaggtgattttgtggaattattgcaggcagtagagatatttggtttttacttagcatcaattgatatgcgacaagactctagcgtctatgaagcctgtgtggcagaactcttgaaatcagcaggaattcattctcgttatagcgagttgagcgaagaagaaaagtgtgaccttctcttgaaagaattagaagaagatccccgaattctttctgcgactcacgcagaaaaatcagaattattagcaaaagaattagctatttttaagacggctcgtgttttgaaagataagttgggagatgatgtcatccgtcagaccatcatttcacatgcaaccagcctttctgatatgctagaattagctattctgttaaaagaagtaggactggtggatacggaaagggcgcgtgttcagattgttcccctttttgaaacaattgaagacttggatcattcagaggaaacaatgagaaaatatctttctcttagccttgccaaaaaatggattgactcacgaaataactaccaagaaatcatgcttggctactctgacagtaataaagatggcggttacttgtcatcatgttggaccctctacaaggctcaacaacaattgactgctattggagatgaatttggcgttaaggttaccttcttccatggtcgtggtggtactgtcggtcgtggtggtgggccaacctatgaagccattacatctcaaccgctcaagtctatcaaggatcgtatccgcttgacggagcagggtgaagtaattgggaataaatacggtaacaaagacgccgcttactataaccttgaaatgctagtatcggcagctattaaccgtatgattactcagaagaagagcgataccaataccccaaatcgttatgaaaccattatggatcaagtagtggaccgtagttacgatatctaccgtgatttggtctttggtaatgagcatttctatgattatttcttcgagtcaagtccaatcaaggctatttcaagttttaatattggttctcgtccagccgctcgtaagactattactgaaatcggtggtttgcgtgccatcccttgggtattctcatggtcacagagtcgtgttatgttccctggatggtacggggttggttcaagcttcaaggaatttatcaataaaaatccagagaatattgctatcttacgagatatgtaccaaaattggcctttcttccaatcgcttctttcaaatgttgatatggttttgtcaaaatcaaatatgaatattgcttttgaatatgctaaactttgtgaagacgagcaagttaaggccatctatgagactattttaaatgaatggcaagttactaagaacgttatcttggctattgaaggacatgacgaactcttagctgacaatccatatctaaaagctagtctggattaccgtatgccttactttaatattctcaactatattcagttggagttgattaaacgccaacgtcgtggagaattgtccagtgatcaagaacgattgattcatatcaccatcaacggaattgcgacaggattgcgtaattcaggttga

SEQ ID NO: 504 - DNA, 372 bp, Streptococcus pneumoniae
aagaaattatcggaggttagccatatggcatttgaaaaaatcattcagttaaaaaattgtcgttacgattacactcttagcccttctgttaaaaaattcaccctcaaagataacaccttttttgaaactaaggttggtaactatgaactgactcgccttttggaaaaagtgccaaacagcggtgaaggcttccaactcaaaatcatcattaacaaggaacttacaggggctaaaatcaatatcactgacaagtttggccttcgtctagttgatattttcaaatcagaagaccaccatattcatcaggaaaaattctacttcctcatggatagcttggtagaacgtggtgtctttacaaaatcggaaagatag

SEQ ID NO: 505 - DNA, 1050 bp, Streptococcus pneumoniae
aatagaaaagataaaaatacacaaatcccagttcatatatgtaaggtaaatataactaggatttataaagtttacagaggacggtctataatgtcagatagaaaaaacatgaaacttttcgcactcaactctaaccaagagattgcacaaaaaattgcccaagctgttggtgtcccacttggaaaactatcatcacgtcaattttcagacggagaaatccaagtaaatatcgaagaaagtgtccgtggttatgatgtttacatcatccaatcaacaagtttccctgtcaacaaccacctaatggaattgttaatcatggtcgatgcttgtgtgcgtgcaagtgcccacagtatcaacgttgtccttccatattttggctatgcacgtcaagaccgcattgcttgtcctcgtgagccacttacagcaaaactagttgccaatatgctggttaaggctggagttgatcgtatcctgactcttgatttgcatgccgttcaggttcaaggtttctttgatattccagtggataatcttttcactgttcccctattcgcaaaacattactgcgataaaggattgcttggttcagatgttgttgtcgttagccctaaaaattcaggtgtcaaacgtgcgcgtagcctggctgaatatcttgatgctcctatcgccattatcgactaccctcaagacgatgcaactcgtaacgaaggttatattattggtgatgttgaaggtaagaaagctatcttgattgatgatattttaaatacaggacgtaccttctctgaagcttctaaaatcgttgaacgtgaaggagctacagaaatttatgctgtttctagccacggtctcttcgtcgagggagctgctgagcttcttgacaatactaatattaaagaaattcttgtgactgattcagtagcaacaaaagaaaaaactcctaaaaatgtatgctacatcactgctagtgagttaattggtgatgctatcgtccgtattcacgaaagaaaaccagtcagcccactctttgcctacaataaaaagaaataa

SEQ ID NO: 506 - DNA, 1470 bp, Streptococcus pneumoniae
aaatttggtaaaatatatcttaatcattttcaggaggacaaaaatttgacaagatatcagaatttagtaaatggaaaatggaaatcatctgaacaagaaattacgatttattcaccaatcaatcaagaagaattgggtacagttccagccatgactcagactgaagctgatgaggctatgcaagctgcgcgtgcagccctgccagcatggcgagctttatcagcagttgaacgtgcggcttatttgcataaaacagcagctattttagaacgcgataaggaagaaattggtactatccttgccaaagaagtagcaaaagggattaaagcagcaattggagaagtagtgcgtacagcagacttgattcgttatgctgctgaggaaggtctccgtatcactggacaagcaatggaaggtggtggttttgaggcaacaagtaaaaacaaactggctgttgtccgtcgtgaaccagttggtatcgtgctagcgattgctccctttaattatccagttaatttatctgcttctaaaattgcacctgccttgattgcagggaatgtggtcatgtttaagccaccaacacaaggttccatttctggactcttgttggctaaagcatttgaagaagcagggattccggcaggtgttttcaacaccattacaggtcgtggttcagaaattggggattatatcattgagcacaaagaagtcaacttcatcaactttacaggttcaactcctattggagaacgtattggtcgtttagctggtatgcgtcctatcatgttggaacttggtgggaaagatgcagctcttgtactagaagatgcagatttggaacatgctgccaagcaaattgttgcgggagcctttagctactcaggacaacgttgcacggccattaaacgtgtcattgttctcgaaagtgtagcagataaattagctactttgcttcaggaagaagtttctaaattaacagttggtgatccatttgacaatgctgatattacacctgttattgacaatgcttcagccgacttcatttggggcttgattgaggatgcacaagaaaaagaagctcaggctcttacaccaatcaaacgtgagggcaatcttctctggccagtgctttttgaccaagttacaaaagatatgaaagtggcatgggaagagccatttggtcctgttttaccaatcattcgtgtggctagtgtagaggaagctattgcctttgccaacgaatctgaattcggccttcaatcatcagtctttacaaatgatttcaaaaaagcctttgaaattgctgaaaaacttgaagtaggtacagtccacattaataataaaacccagcgtggtccagataatttcccattccttggtgtcaaaggttctggagctggagtgcaaggaattaaatatagcattgaagcgatgacaaatgtcaaatccattgtttttgatgtgaaataa

SEQ ID NO: 507 - DNA, 993 bp, Streptococcus pneumoniae
aagaggtataaaatggctttaacagaacaaaaacgtgtacgcttagaaaaactttctgatgaaaatggtatcatctcagctcttgcatttgaccaacgtggtgctttgaaacgcctcatggttaaacaccaaacagaagaaccaactgtggcccaaatggaagaacttaaagtcttggtagcagatgaattgactaaatatgcttcatctatgcttcttgaccctgagtatggacttccagcaactaaagctcttgatgaaaaagctggtcttctccttgcttatgaaaaaacaggttatgacacaacaagcacaaaacgcttgccagactgcttggatgtttggtctgcaaaacgtattaaagaagaaggtgcagatgcagttaaattcttgctttactatgatgtagatagctcagacgaactcaatcaagaaaaacaagcctacatcgaacgcatcggttctgagtgtgtggctgaagatatcccattcttccttgaaatccttgcttacgatgaaaaaattgcggatgcaggttctgtagaatacgctaaagtaaaaccacacaaagttatcggcgctatgaaagtcttttcagacccacgctttaacattgatgttttgaaagttgaagttcctgttaacattaaatatgttgaaggcttcgctgaaggtgaagtagtttatacacgtgaagaagcagcagccttcttcaaagcgcaagatgaagcaacgaacttgccatacatctacttgagtgctggtgtatcagctaaactcttccaagatactcttgtatttgctcatgaatcaggtgcgaactttaacggagttctttgtggccgtgctacatgggcaggatcagttgaagcttacatcaaagatggtgaagcagcagctcgcgaatgcgttcgcacaactggatttgaaaacattgacgaactcaacaaagttcttcaaagaacagcaacttcatggaaagaacgcgtgtaa

SEQ ID NO: 508 - DNA, 546 bp, Streptococcus pneumoniae
ttagattatagtaagaaaggtaagttaaaaatgagaattgcaattggatgtgaccacatcgtaactgatgaaaaaatggcggtttcagaatttttgaaatcaaaaggatatgaagtcattgactttggtacctatgaccatacacggactcactacccaatctttggtaaaaaagtaggggaagctgtaactagcggtcaagctgatcttggagtatgtatctgtggtactggtgttggtatcaacaacgctgtaaataaagttccaggtgttcgttctgccttggttcgtgatatgacaacagccctttatgctaaagaacaattgaacgctaacgttattggttttggtggtaaaattactggtgaattgcttatgtgtgatatcatcgaagctttcatccatgctgaatacaaaccaactgaagaaaacaaaaaattgattgcgaaaattgaacatgttgaaagtcacaatgctcaacaaacagacgcaaacttctttacagaattccttgagaaatgggatcgtggagaataccacgactaa

SEQ ID NO: 509 - DNA, 441 bp, Streptococcus pneumoniae
aaaggagtatacaatatgtctattgttatcggtgcagatgctgcaggtttgagattgaaagaagttgtgaaagacttcttagaaaaagaaaacttccaccttgtggatgttacagctgaaggtcaagactttgttgatgtgactctcgctgttgctgcagaagtaaacaaagaagaacaaaaccttggtatcgtgattgatgcttatggagctggtccatttatagttgcaactaagatcaaaggaatggttgctgcagaagtatctgacgaacgttcagcttatatgactcgtggccacaacaactcacgtatgatcactatgggagcacaacttgttggtgatgaattggctaaaaatatcgctaaaggatttgttaatggtaaatacgacggtggtcgtcaccaaatccgggttgacatgttgaacaaaatgggctaa

SEQ ID NO: 510 - DNA, 1893 bp, Streptococcus pneumoniae
cagggtatggtcttgtcaaaatatcaaaaacaatttataataaatagataccctgaaaggaagagaatcatgaacttagaagaattgaaaaaacgacaggagaagatccgtaacttctctattatcgcccatattgaccacggaaaatcaactctagcagaccgcattttggaaaaaacagagacggtttcaagtcgtgaaatgcaggcccagcttttggatagcatggagctagagcgggaacgtggaattactattaagttgaatgccatcgagttgaattacactgcaaaagatggggaaacttatattttccacttgattgacacaccagggcacgttgactttacctatgaagtttcacgttcgctagctgcctgtgagggtgctattttggtggtcgatgcggctcaaggaattgaggctcaaactcttgccaacgtttatctggctttggataatgatttggaaatcatgcctatcattaataaaattgacctgccggctgcagatccggagcgcgtgcgtacagagattgaagatgtgattggtttggatgccagtgaagcagttttggcttctgccaaggctggtattgggattgaagaaatcctcgagcaaattgtagaaaaagtaccagcaccaacgggtgatgtgacggcgccacttaaggccttgattttcgactctgtttacgatgcttaccgtggggttatcctccaagtgcgtgtcatggacggagtggtcaaacctggtgataagattcagctcatgagcaatagtaagacctttgatgtggccgaagtcggtatttttacaccaaaagcggttggtcgtgatttccttgcgactggtgatgttggttacattgcggcgtctatcaagacggttcaggatactcgtgtgggtgataccgttaccttggcaaccaatcctgcggcagaaccattacatggttataagcagatgaatcctatggtctttgcgggtctctacccaatcgaatcaaacaagtacaatgacctgcgtgaagcgcttgaaaaattgcaactgaatgatgctagtcttcagtttgaaccagaaacatctcaggcacttggatttggtttccgttgtggatttcttggacttctccatatggatgttatccaggaacgtttagagcgtgagttcaatattgacctcatcatgacagctccgtctgttatttacaaagttaatttgaccgacggtgagtctatggatgtgtctaacccatctgagtttccagacccaactaagattgcgaccattgaagagccttatgtcaaggcgcaaatcatggtaccacaggagttcgtcggagcagtaatggagctagctcagcgtaagcgtggggactttgtgactatggactatattgatgataaccgtgtcaatgttatctatcaaattcctcttgctgaaattgtctttgacttctttgataaacttaagtcttcgacacgtggttatgcaagctttgactacgaattgtcagaatatcgcccatctaagctggtgaaaatggatattcttctcaatggagataaggtggatgccctcagctttatcgttcacaaggactttgcctacgaacgtgggaaactcatcgttgataaactcaagaaaatcatccctcgccaacaatttgaagttccaatccaagcggctattggacacaagattgtcgctcgtactgatatcaaggcccttcgtaagaacgtacttgctaaatgttatggtggtgacgtttctcgtaagcgtaaactccttgaaaaacaaaaagctggtaagaaacgcatgaaatccatcggatcagttgaagttccgcaagaagccttcctcagcgtcttgagtatggatgaagaataa

SEQ ID NO: 511 - DNA, 1347 bp, Streptococcus pneumoniae
gtggagatggaaaagtatttatcggtaacaactttgaccaagtatctgaaaatgaaattcgataaagacccatacttggaacgggtctatttaactggtcaagtttccaactttcgtaaacgacctactcaccaatatttctccctaaaggatgaccatgcagttattcaagcgaccatctggtctgggatttatcagaaattagggtttgacctggaagaaggaatgaagatcaatgtgattgggcgtgtacaggtctatgaaccaagtggtagctactccatcatcattgaaaaagctgagcctgatggggttggggcgcttgcgattcagtttgaacaacttaagaaaaaattgacagaagaaggcctgtttcaagaacgcttcaagcaagctctgccccaattttctaagagaattggtgtagtaaccagccgtagtggagccgttattcgagatattatcacgaccgtcagcaggcgattcccaggtgttgacatccttctttatccgaccaaggttcaaggtgaaggggctgcggaggaaattgctagaaatattgcgcgtgctaatcaacgggacgatttggatttgctcattattggtcgtggaggtggttctattgaggatctctgggcctttaacgaagaaattgtggtacgagctatttttgaatctcgtttgccagttatctctagtgtggggcatgagacggatgtgaccttggcagattttgtggcagatcgacgcgctgcaacgccaacagcggcggctgaactggcaacacctgtgaccaagttggatgtattagctcatttgcaaaatcaggaaaaacggatggtaacggcagtccgaaatgttctatctaagaaacaagaggctttgaaaaaatgcagtcagtctgttatctttagacaacctgagcgcttgtatgacggttatttgcaacgcttggaccaactgcaactgcgtttgaaacaaagtttgcgaactcggatttctgataacaaacaattagttcaagcaagaactcatcaattagtacaattatcacctgttaccaaaatccaacgctatcaagaccgtttaggacagttggacaagctcttaggtagccaaatggcgttagtttatgacgccaaggttgctgaggccaagcgactttcggaagctttgctcatgttggatactagccgaatcgtggcgcgtggttatgctattgtcaaaaaagaagagtccgttgtagattcggttgagagtttgaagaaaaaagaccaagtaacgcttttgatgcgagatggtcaagtagaattagaggttaaagatgtcaaaacaaaagaaatttga

SEQ ID NO: 512 - DNA, 750 bp, Streptococcus pneumoniae
agcataatgtctcaaaaaaataataaaaagaaaaacaagcgaaaaaatctgctgacaaatatcctagcaggatttctgatattactgtcactggctttgatttttaatactcaaattcgaaatattttcatagtctggaataccaataagtatcaagttagccaggtatcaaaagaaaaattagaagaaaatcaggatacagaaggcaattttgactttgattctgtcaaagctatctcttcggaagctgttctaacttctcaatgggatgctcaaaaattaccagttattgggggaattgcaattcctgaattggaaatgaatttgccgatttttaaaggacttgataatgttaatctcttctacggagctggtacaatgaaacgcgagcaagtaatgggagaaggaaattatagtctagctagtcaccatatctttggtgttgataatgctaataaaatgttattttctcctttagataatgctaaaaatggcatgaagatttatctaaccgataaaaataaagtttatacttatgaaatacgtgaagtcaaacgtgtgacaccggatcgtgttgatgaagttgatgatagagatggggtcaatgaaatcacattagtaacctgtgaagaccttgctgctacagaacgtattattgtcaaaggtgatttgaaagaaacaaaagattattcacaaacatctaatgaaatcctaacagctttcaatcaaccatataaacaattttattaa

SEQ ID NO: 513 - DNA, 1026 bp, Streptococcus pneumoniae
ggaaaatcccctaataaaattaaggagatgtttaaaacaatgacttcaactaaacaacacaaaaaagttatccttgtcggtgatggtgctgtaggttcatcttacgcttttgcacttgttaaccaaggaattgcacaagagcttggaattatcgaaattccacaattgcatgaaaaagctgttggtgatgcgcttgaccttagtcacgcccttgccttcacttcacctaaaaaaatctatgcagctcaatactctgactgtgcagacgctgaccttgttgtgatcactgcaggtgcacctcaaaaaccaggtgaaactcgtcttgaccttgtaggtaaaaaccttgctatcaacaaatcaatcgtaactcaagttgttgaatctggtttcaaaggtatcttccttgttgctgctaacccagttgacgttttgacttactcaacttggaaattctctggtttccctaaagaacgcgttatcggttcaggtacttcacttgactcagctcgtttccgtcaagcacttgctgaaaaattggatgtggatgctcgttcagtgcacgcctacatcatgggtgaacacggtgactctgagttcgctgtttggtcacacgctaacatcgctggtgtaaaccttgaagaattccttaaagacactcaaaatgttcaagaagctgaattgattgaattgttcgaaggtgttcgtgatgcagcctacacaatcatcaacaaaaaaggtgcaacatactacggtatcgcagtagcccttgctcgtatcactaaagcaatccttgacgatgaaaacgcagtacttccactttcagtattccaagaaggtcaatacggagttgagaatgtctttatcggtcaaccagctgttgttggtgcacatggtatcgttcgtccagtaaatatcccattgaacgacgcagaaactcaaaaaatgcaagcatctgctaaagaattacaagctatcattgacgaagcatggaaaaacccagaattccaagaagcttctaaaaactaa

SEQ ID NO: 514 - DNA, 588 bp, Streptococcus pneumoniae
aaaaattcaagcctatcattcttagaaaggaaaactatggcaaacattctcttggctgtaacgggttcaatcgcctcttataagtcggcagatttagtcagttctctaaaaaaacaaggccatcaagtcactgtcttaatgactcaggctgctacagagtttatccaacctttgacactacaggtactctcacagaatcctgtccacttggatgtcatgaaggaaccctatcctgatcaggtcaatcatatcgaacttggaaaaaaagcagatttatttatcgtggtacctgcaactgctaacactattgcaaaactagctcacggatttgcggacaacatggtaaccagtacagctctagccctaccaagtcatattcccaaactaatagctcctgctatgaatacaaaaatgtatgaccatccagtaactcagaataatctgaaaacattagaaacctacggctatcagctgattgctcctaaggaatccctactagcttgtggagaccacggacgaggagctttagctgacctcacaattattttagaaagaataaaggaaactatcgatgaaaaaacgctctaa

SEQ ID NO: 515 - DNA, 924 bp, Streptococcus pneumoniae
acacagcctttaaaacagtgtttaagtgggaagtataagtactggaggttaattgtggagaaaatcattaaagaaaaaatttcttccttacttagtcaagaagaggaagtcctcagtgttgaacaactgggtggaatgaccaatcaaaactatttggccaaaacaacaaataagcaatacattgttaaattctttggtaaagggacagaaaagcttatcaatcgacaagatgaaaagtacaatcttgaactactaaaggatttaggcttagatgtaaaaaattatctttttgatattgaagctggtatcaaagtaaatgagtatatcgaatctgcgattacgcttgattcaacgtcaatcaagaccaagttcgacaaaattactccaatattacaaactattcatacgtctgctaaggaattaagaggagaatttgctccttttgaagaaatcaaaaaatacgaatccttgattgaagaacaaattccttatgccaactatgaatctgttagaaatgcagtcttctccttagagaaaagactggctgacttaggtgttgacagaaaatcttgtcatatcgatttggtgcctgaaaactttatcgaatcacctcaaggacgactttatttgattgactgggaatattcatcaatgaatgatccaatgtgggatttggctgccctctttttagagtctgaattcacttcccaagaggaagaaactttcttatctcactatgagagtgaccaaacaccggtttctcatgaaaagattgctatttataaaattttacaagatactatttggagtctatggactgtctataaggaagagcaaggtgaagattttggtgactatggtgtgaatcgttaccaaagagctattaaaggtttggcttcttatggaggttcagatgaaaagtaa

SEQ ID NO: 516 - DNA, 813 bp, Streptococcus pneumoniae
gagtttaaaatgaaacaactaaccgttgaagatgccaaacaaattgaattagaaattttggattatattgatactctctgtaaaaagcacaatatcaactatattattaactacggtactctgattggggcggttcgacatgagggctttatcccttgggacgacgatattgatctgtccatgcctagagaagactaccaacgatttattaacatttttcaaaaggaaaaaagcaagtataagctcctatccttagaaactgataagaactactttaacaactttatcaagataaccgacagtacgactaaaattattgatactcgaaatacaaaaacctatgagtctggtatctttatcgatattttccctatagatcgctttgatgatcctaaggtcattgatacttgttataaactggaaagcttcaaactgctgtctttcagtaaacataaaaatattgtctataaggatagccttttaaaagattggatacgaacagccttctggttactccttcgaccggtttctcctcgttattttgcaaataaaatcgagaaagaaattcaaaaatatagtcgtgaaaatgggcaatatatggcttttatcccttcaaaatttaaggaaaaggaagtcttcccaagtggtacctttgataaaacaatcgatttaccctttgagaatttaagccttcctgcacctgaaaaatttgatactattttgacacaattttatggagattatatgaccctaccaccagaagaaaaacgcttctacagtcatgaatttcacgcttataaattggaggattag

SEQ ID NO: 517 - DNA, 357 bp, Streptococcus pneumoniae
gagaataaaatgaatccattaatccaaagcttgactgaaggtcaacttcgtacagatatcccatcattccgtcctggtgacactgttcgtgtacatgcgaaagttgtcgaaggtaaccgtgaacgtatccagatttttgaaggtgttgttatcgcacgtaaaggtgctggaatctcagaaaactacacagttcgtaaaatctctaacggtgtaggtgttgagcgtatcttcccaatccacactccacgtgttgaaaaaatcgaagttgttcgttacggtaaagtacgtcgtgcgaaattgtactacttgcgtgctcttcaaggtaaagcagctcgtatcaaagaaatccgtcgttaa

SEQ ID NO: 518 - DNA, 459 bp, Streptococcus pneumoniae
attgaggaggacgatatggcattagcaaaaattgtatttgccagtatgaccggtaataccgaagaaattgcagatattgtagcagacaaattacgtgacttgggcttggatgttgatgttgatgaatgtacaactgttgacgcttcagacttcttggaagcagacatcgctatcgttgcgacctatacttatggtgatggtgaattgccagatgagatgatggacttctacgaagacctagcagatctcaacttgaatggcaaaatctacggagtggtcggctcaggagataccttctacgatgaattctgtaaggctgttgatgactttgaccgtgtctttgtgtcaacaggagcagaaaaaggttcagagtgtgttaaagttgatctttctgccgaggaagaagatattgaacgcttggaacaattcgcagaagaattggctgctaaagtaggataa

SEQ ID NO: 519 - DNA, 438 bp, Streptococcus pneumoniae
gctacacagcgtagcctagctacgaaaaaaactattataaaatttaaaacttatttggaggaaataacaatggcattgaacattgaaaacattattgctgaaattaaagaagcttcaatccttgaattgaacgaccttgtaaaagctatcgaagaagaatttggtgtaactgcagctgctcctgtagctgttgctgcagctgatgcagctgatgctggtgctgctaaagattcattcgacgttgaattgacatctgcaggcgacaaaaaagttggcgttatcaaagttgtacgtgaaatcactggtcttggtcttaaagaagctaaagaacttgttgacggtgcaccagcacttgttaaagaaggcgttgcaactgcagaagctgaagaaatcaaagctaaattggaagaagctggagcttcagttactcttaaataa

SEQ ID NO: 520 - DNA, 627 bp, Streptococcus pneumoniae
atatcctaccgaggacaaaacgtatcatgtaaaaagaagcgtattgtactttcgtgtctaggtttgggcgcgtttttctttttgaaaaattccccaagcaaaataattacggaggtgaacacactaatgagtgaagcaattattgctaaaaaagcggaactagttgacgtagtagctgaaaaaatgaaagctgctgcatctatcgtcgttgtagacgctcgtggtttgacagttgagcaagatacagttcttcgtcgtgagcttcgtggaagcgaagttgagtataaagttattaaaaactcaatcttgcgtcgtgcagctgaaaaagctggtcttgaagatcttgcatctgtatttgttggaccatctgcagtagcattttctaatgaagatgttatcgcaccagcgaaaatcttgaacgacttttctaaaaacgctgaagcacttgaaattaaaggtggtgcaatcgaaggcgctgtcgcatctaaagaagagattcttgcacttgcaactcttccaaaccgcgaaggacttctttctatgctcctttctgtacttcaagcgccagtgcgcaacgttgctcttgcagtcaaagcggttgcagaaagcaaagaagacgcggcttaa

SEQ ID NO: 521 - DNA, 1809 bp, Streptococcus pneumoniae
aatccagccaagtctattgtgaaatcaatgcatcccaacatggaaaggaggactagaatgaaacgacaaactgtaaaccagacgctcaaacgtttagccgtagatttagcaagccatcctttcctccttttcctagcctttctaggaactattgcccaagttggcttatcaatttacctacctattctgattgggcaggtcattgaccaagtcctagtggctggttcatcaccagttttttggcagatttttctccagatgctcttggtggtaataggaaatactctggtacaatgggccaatcctctcctctataatcgtctaatcttctcttataccagagatttacgggagcgaatcatccataagctccatcgtttaccgattgcctttgtagataggcaaggtagtggagagatggttagtcgtgtaaccacggacatcgaacagttggcagctggcttgaccatgatttttaaccaatttttcattggtgttttgatgattttggtcagtattctagccatgctccaaattcatctcctcatgactctcttagtcttgctgttgacgccactgtccatggtgatttcacgctttattgccaagaaatcctatcatctcttccagaagcaaacagagacgaggggaattcagactcagttgattgaagaatcgcttagtcagcagactataatccagtccttcaatgctcaaacagaatttatccaaagattgcgtgaggctcatgacaactactcaggctattctcagtcagccatcttttattcttcaacggtcaatccttcgactcgctttgtaaatgcactcatttatgcccttttagctggagtaggagcttatcgtatcatgatgggttcagccttgaccgtcggtcgtttagtgacttttttgaactatgttcagcaatacaccaagccctttaacgatatttcttcagtgctagctgagttgcaaagtgctctggcttgcgtagagcgtatctatggagtcttagatagccctgaagtggctgaaacaggtaaggaagtcttgacgaccagtgaccaagttaagggagctatttcctttaaacatgtctcttttggctaccatcctgaaaaaattttgattaaggacttgtctatcgatattccagctggtagtaaggtagccatcgttggtccgacaggtgctggaaaatcaactcttatcaatctccttatgcgtttttatcccattagctcgggagatatcttgctggatgggcaatccatttatgattatacacgagtatcattgagacagcagtttggtatggtgcttcaagaaacctggctcacacaagggaccattcatgataatattgcctttggcaatcctgaagccagtcgagagcaagtaattgctgctgccaaagcagctaatgcagactttttcatccaacagttgccacagggatacgataccaagttggaaaatgctggagaatctctctctgtcggccaagctcagctcttgaccatagcccgagtctttctggctattccaaagattcttatcttagacgaggcaacttcttccattgatacacggacagaagtgctggtacaggatgcctttgcaaaactcatgaagggccgcacaagtttcatcattgctcaccgtttgtcaaccattcaggatgcggatttaattcttgtcttagtagatggtgatattgttgaatatggtaaccatcaagaactcatggatagaaagggtaagtattaccaaatgcaaaaagctgcggcttttagttctgaataa

SEQ ID NO: 522 - DNA, 1053 bp, Streptococcus pneumoniae
acaaaggagaaaaaaatcatgtttgaacattattcagtagctgatttgtttgcaaatctttataaaaagcgaaaagcaaatattttagctctcatcgctttatttgctctcattgctgtaccatttacaattaaagcagttaggaataaaaacactgtcaaagatacaacaagttattcaacttatcttatctataaaatcactcctccaaaagagtcggacaaaacgattttgaatcatcaaattggtggttatagtgatttttatgggaaattgattgatggtaatttgaatggagcttatcttttcaatgatgtagaacccagtgagttgaaaaaaattgccagtgaattagacacgacagaaacaaccttgaaaaattcaacgaatgactattggtggaaaaaattgaccgtctactatatgattgacgatgcaggggttggtgtgaaaattttgacatcaagtaaagatgccaataacttgttagagaaaaaaattgatgggttgattgagaaatttaaacatgcctatgcaaatgtgaaaattgaaaaactggaaaccatcaactctaaagaattgaacgcaaatggtgaaacagcgcttggcttaaatgtgaaaaatctgattcttcgtttagttgttattggagtggtttgtgtgattttggttgtgatgggaaatgtgttagtttatctctttaatccaacaatcaatagagtaggtgatttttctcagtatcaaattgattttgtaacagagattacaacaattgctaacctagcagatgttttgtcatacaaaaatactggacaggaattgaccatcgttagctcaaataaagctatcttagataaattgaaacagagtcaagaagctttaaaaggaatgcattttgtagatttacaggatgtatcatctcttttggaaagagatacagtccttcttgttgaagagtacggagtgactcgttataagaaatttgagcaaagtcttcaaattctcagaaacttaaatcgttctatcctcggtgtagcaacctttaaattataa

SEQ ID NO: 523 - DNA, 1329 bp, Streptococcus pneumoniae
aattctgggtgcctatcctatttatccaatatcagaccatggaaaggagagaagatgagtaaagaaaatcccttaagtcatcatgagcagttgcgttatgattatttgctaaaaaatattcactatctcaatgagagagaaaaaaatgagtttgcctatttgcaagaaaagctaactcttgctaggggaaatagtagctctagcttggaacaagaaagagaagagcaggttgacttaccaagctatgcgaaccggagtcgctcacaatccaaatcacaagcactctctttccctccaaaaaagaaaagacggaagctccgtcttaaacgaatttttatggtgattttttcacttttggtctgtgtggctttggccatggtattcatgtttttgcgtggttaccaagatgctagcgcaaagaaaactgctgatgcccgggcagctcaagtagaagtctttaatggtcaggacactagagatggagttaatattttaatcatgggtactgatggtcgaatcggccagaacagtgttgagacacgaactgactctattatggtattaaatgtcgggggctcagataagaaaatgaagctagtcagtttcatgcgtgataatttggtctatatagatggttatagtcaagtgattaatggtagaaaacagacagataacaagttaaacgtagcctacgagttaggagaacaagaggggcaaaaaggggcagaaatggttcgccaagtcttgaaagataattttgacttggacattaagtactacgccttggttgatttccaggcctttgccacagcgattgacacgcttttccctgatggggtgacgattgatgctcaattttcaacattgaatgggcgtcccctaacagaagctacagtcggagatgatttatacgctaccgagactgagtctccaacccaaaccattaaagtcggaaaacagcagatgaatggctcgaccctgctcaattatgctcgtttccgtgatgatgatgaggcagattacggccgtacaaaaagacagcaacaagttttaacagcaattttagagcaaattaaagatcccactaaacttttcactggttctgaagctcttggaaaggtttttgctatgacctcaaccaacgtaccctatactttcctcctaacaaacggtttatctgttttggatggagcaaaaaatggtattgaaaaattgacgattccagaactgggtgactgggtagatgcctatgatgtttatgggggcttgggcctgctggttgatcaaaacaaatatcaaaccaagctcgctcaaatgggcttaagataa

SEQ ID NO: 524 - DNA, 825 bp, Streptococcus pneumoniae
ccgctgcctaaaggagaagccatgtcaacatataactgggatgagaagcatatccttacctttcctgaagaaaaagtagccctttctactaaggatgtccatgtttactatggtaaaaatgaatccattaaggggattgatatgcaatttgaaagaaataaaattacagctttgattggcccgtcgggatcggggaaatctacctacttacgcagtctcaatcgcatgaatgatactattgatattgctaaagtaactgggcagattctctatcgtggaattgatgtcaaccgtccagaaatcaacgtttatgaaatgcgtaaacacattggaatggtttttcaacgtcccaatccatttgctaagtcaatttaccgtaatattacctttgcgcatgaacgtgctggagttaaggataagcaagtcctagatgaaatcgtagaaacctcccttcgtcaggctgccctctgggatcaggttaaagacgatctccacaagtcagccttgaccttatcaggtggtcagcaacaacgtctctgtatcgctcgtgccatctctgttaagccagatatcctcttaatggatgagccagcctcagccttggatccgattgcgaccatgcaactagaagagaccatgtttgagctcaagaaaaactttaccatcatcattgtaacgcataatatgcagcaggctgctcgtgcaagtgactatacaggcttcttttacttgggtgatttgattgagtatgacaagactgcaactattttccaaaatgccaagctacagtccaccaatgactatgtatctggtcactttggttag

SEQ ID NO: 525 - DNA, 1395 bp, Streptococcus pneumoniae
aggcaggaaatttttatgagtaaaatcgttgtagtcggtgctaaccacgctggtacagcatgtatcaataccatgttggataattttggaaatgagaacgaaattgttgtatttgaccaaaactctaacatctctttcctaggatgtggaatggctctttggattggtgaacaaattgacggtgctgaaggcttgttctattctgataaagaaaaattggaagctaaaggtgctaaagtttacatgaactcacctgttctttcaatcgactatgataacaaagtagttacagcggaagttgaaggaaaagagcacaaagaatcatacgaaaaattgattttcgctacaggctctacaccaatcttgccaccaatcgaaggtgttgaaattgttaaaggaaaccgcgaatttaaagcaactcttgaaaacgtacaattcgtgaaattgtaccaaaatgctgaagaagttatcaataaactttctgacaagagccaacacctcgaccgtatcgccgttgttggtggtggttacatcggtgttgaacttgctgaagcctttgaacgtcttggaaaagaagttgtccttgttgatatcgttgatactgtcttgaacggttactatgacaaagacttcacacaaatgatggcgaagaacttggaagatcacaacatccgcttggctctaggtcaaactgttaaagcaatcgaaggtgacggtaaagttgaacgcttgattactgacaaagaaagctttgacgtggatatggttatccttgcagttggtttccgtccaaacacagcccttgcaggtggtaagatcgaactcttccgcaacggtgccttccttgtagacaagaaacaagaaacatctatcccagacgtttacgctgttggtgactgtgcgactgtttatgacaatgctcgtaaagatacaagctatatcgctcttgcttcaaatgctgttcgcactggtatcgttggtgcctacaatgcttgtggacatgaattggaaggaatcggtgttcaaggttcaaatggtatctcaatctacggtcttcacatggtttcaactggtttgactcttgaaaaagcgaaagctgctggttacaacgcaactgaaacaggctttaacgatcttcaaaaaccagaattcatgaaacatgacaaccatgaagtagcaattaagattgtctttgacaaagatagccgtgaaattcttggtgcccaaatggtttcacatgatattgcaattagcatgggaatccacatgttctcacttgctatccaagagcatgtgacaattgataaattggcattgacagacctcttcttcttgccacacttcaacaaaccatacaactacatcacaatggctgcccttacggctgaaaaataa

SEQ ID NO: 526 - DNA, 1263 bp, Streptococcus pneumoniae
ggaaagttagactgtattgcctactgtctatctataaaatatattttattggaggcttttactcaaatggcaaaagaaaaatacgatcgtagtaaaccacacgttaacattggtactatcggacacgttgaccacggtaaaactaccctaactgcagctatcacaactgttttggcacgtcgcttgccttcatcagttaaccaacctaaagactatgcgtctatcgatgctgctccagaagaacgcgaacgcggtatcactatcaacactgcgcacgttgagtacgaaactgaaaaacgtcactacgctcacatcgacgctccaggacacgcggactacgttaaaaacatgatcactggtgctgctcaaatggacggagctatccttgtagtagcttcaactgacggaccaatgccacaaactcgtgagcacatccttctttcacgtcaggttggtgttaaacaccttatcgtcttcatgaacaaagttgacttggttgacgacgaagaattgcttgaattggttgaaatggaaatccgtgacctattgtcagaatacgacttcccaggtgacgatcttccagttatccaaggttcagcacttaaagctcttgaaggtgactctaaatacgaagacatcgttatggaattgatgaacacagttgatgagtatatcccagaaccagaacgtgacactgacaaaccattgcttcttccagtcgaggacgtattctcaatcactggacgtggtacagttgcttcaggacgtatcgaccgtggtatcgttaaagtcaacgacgaaatcgaaatcgttggtatcaaagaagaaactcaaaaagcagttgttactggtgttgaaatgttccgtaaacaacttgacgaaggtcttgctggagataacgtaggtgtccttcttcgtggtgttcaacgtgatgaaatcgaacgtggacaagttatcgctaaaccaggttcaatcaacccacacactaaattcaaaggtgaagtctacatccttactaaagaagaaggtggacgtcacactccattcttcaacaactaccgtccacaattctacttccgtactactgacgttacaggttcaatcgaacttccagcaggtactgaaatggtaatgcctggtgataacgtgacaatcgacgttgagttgattcacccaatcgccgtagaacaaggtactacattctctatccgtgagggtggacgtactgttggttcaggtatggttacagaaatcgaagcttaa

SEQ ID NO: 527 - DNA, 873 bp, Streptococcus pneumoniae
caaatggatttcacatgggcactgaagtatgccactgaatttttgggaactgccattttgatcattcttgggaatggtgcagttgccaacgttgaacttaaaggtacgaaaggtcaccaaagtggctggatcgtcatcgctgttggttatggtatgggggttatgatcccagccttgatgtttggtaacgtatctgggaatcacatcaaccctgctttcactctagggcttgcagttagcggtcttttcccttgggcacaagtggtaccttacattatcgcgcaagtcttgggggctatctttggccaagccttagttgtggcaacataccgtccattctacttgaaaactgaaaacccaaataacatcttgggaactttctcaactatttcaagtattgaccatggtacaaaagaaagtcgctatgcagcaactgtcaatggtttgattaatgagtttgttggttcatttgttttgttctttgcagctcttggtttgactaaaaacttctttggtgctgaagtgcttcaattcatgaaacaaaaggcaacagaagcaggacaaacagttgatttttctgacttggctattaaagcacaggtggctccacacactgcttcaggactttctgtggctcacttggcacttggattcctcgttatggctttggtaacatcacttggaggacctacaggacctgccttgaacccagcccgtgacttgggaccacgtctccttcatgctttccttcccaaatcagttcttggtgagcataaaggcgattcaaaatggtggtattcttgggtaccagtagtagcacctatcgcagcagcaattgcggcagtagctgtattcaaattcctttatctctaa

SEQ ID NO: 528 - DNA, 1416 bp, Streptococcus pneumoniae
gagaaggagatgagttcaggtaaaattgctcaggttatcggtcccgttgtagacgttttgtttgcagcaggggaaaaacttcctgagattaacaatgcacttgtcgtctacaaaaatgacgaaagaaaaacaaaaatcgtccttgaagtagccttggagttaggagatggtatggttcgtactatcgccatggaatcaacagatgggttgactcgtggaatggaagtattggacacaggtcgtccaatctctgtaccagtaggtaaagaaactttgggacgtgtcttcaacgttttgggagataccattgacttggaagctccttttacagaagacgcagagcgtcagccaattcataaaaaagctccaacttttgatgagttgtctacctcttctgaaatccttgaaacagggatcaaggttattgaccttcttgccccttaccttaaaggtggtaaagttggacttttcggtggtgccggagttggtaaaactgtcttaatccaagaattgattcacaacattgcccaagagcacggtggtatttcagtatttgctggtgttggggaacgtactcgtgaggggaatgacctttactgggaaatgaaagaatcaggcgttatcgagaaaacagccatggtctttggtcagatgaatgagccaccaggagcacgtatgcgtgttgcccttactggtttgacaatcgctgaatacttccgtgatgtggaaggccaagacgtgcttctctttatcgataatatcttccgtttcactcaggctggttcagaagtatctgcccttttgggtcgtatgccatcagccgttggttaccaaccaacacttgctacggaaatgggtcaattgcaagaacgtatcacatcaaccaagaagggttctgtaacctctatccaggctatctatgtgccagcggatgactatactgacccagcgccagcaacagccttcgctcacttggattcaacaacaaacttggaacgtaagttggtacaattgggtatctacccagccgttgacccacttgcttcaagctcacgtgccttggcacctgaaatcgttggagaagagcactatgcagttgctgctgaagtaaaacgtgtccttcaacgttaccatgaattgcaagatatcattgctatccttggtatggatgagctttctgatgaagaaaagaccttggttgctcgcgcccgtcgtatccagttcttcttgtcacaaaacttcaacgttgcggaacaatttactggtcagccaggttcttatgttccagttgctgaaactgtacgtggctttaaggaaatccttgatggtaaatacgaccacttgccagaagatgccttccgtggtgtaggttctatcgaagatgtgattgcaaaagctgaaaaaatgggattttaa

SEQ ID NO: 529 - DNA, 888 bp, Streptococcus pneumoniae
aggtgtcagatggcagtatctctaaatgatattaaaacaaaaatcgcctcaacaaaaaatacgagtcaaatcactaatgccatgcaaatggtatcggctgctaagctaggtcgttctgaagaagctgctcgcaacttccaagtttacgctcagaaagtgcgtaaacttttgacagatatccttcatggtaatggagctggtgcttcaactaatccgatgttgattagccgttctgtgaagaagacaggctatatcgttatcacttcagaccgcggtttggttggaggttataattcctctattttgaaagctgttatggagttgaaagaagaataccacccagacggtaaaggttttgaaatgatctgtatcggtgggatgggagctgatttctttaaggctcgcggtattcaaccactttatgaattacgtggcttgtcagaccaacctagctttgatcaagttcgtaagattatttcaaaaactgttgaaatgtaccaaaatgaactctttgatgagctttatgtttgctacaaccaccatgtcaatacgctaaccagtcaaatgcgtgtggaacaaatgcttccgattgttgacttggatccaaatgaagcggatgaagagtacagcttgacttttgaattggaaaccagccgagaagaaattctggagcagttgttgcctcagtttgcagaaagtatgatttacggtgccattatcgatgccaagacagctgagaatgctgcgggcatgacagccatgcaaacagcgacagataatgctaagaaagtcatcaatgatttgacaattcagtataaccgtgccagacaggcggcgattacacaagaaattacagaaatcgtagcaggtgctagtgccttagaatag

SEQ ID NO: 530 - DNA, 1536 bp, Streptococcus pneumoniae
agaaaatttgaaatagaaagtggtgttcttttggcaattaacgcacaagaaatcagcgctttaattaagcaacaaattgaaaatttcaaacccaattttgatgtgactgaaacaggtgttgtaacctatatcggggacggtatcgcgcgtgctcacggccttgaaaatgtcatgagtggagagttgttgaattttgaaaacggctcttatggtatggctcaaaacttggagtcaacagacgttggtattatcatcctaggtgactttacagatatccgtgaaggcgatacaatccgccgtacagggaaaatcatggaagtccctgtaggtgaaagtctgattggtcgtgttgtggatccgcttggtcgtccagttgacggtcttggagaaatccacactgataaaactcgtccagtagaagcaccagctcctggtgttatgcaacgtaagtctgtttcagaaccattgcaaactggtttgaaagctattgacgcccttgtaccgattggtcgtggtcaacgtgagttgattatcggtgaccgtcagacagggaaaacaaccattgcgattgatacaatcttgaaccaaaaagatcaagatatgatctgtatctacgtcgcgattggacaaaaagaatcaacagttcgtacgcaagtagaaacacttcgtcagtacggtgccttggactacacaatcgttgtgacagcctctgcttcacaaccatctccattgctcttcctagctccttatgctggggttgctatggcggaagaatttatgtatcaaggtaagcatgttttgattgtatacgatgatctatcaaaacaagcggtagcttatcgtgaactgtcgctcttgcttcgtcgtcctccaggtcgtgaagccttcccaggggatgttttctatctccacagccgtttgcttgagcgctcagctaaagtttctgatgaacttggtggtggatcaattacagccctaccatttatcgagacacaagcaggagatatctcagcctatatcgcaaccaacgtgatttctatcactgatggacaaatcttccttggcgatggcctcttcaatgcaggtattcgtccagccatcgatgcgggttcatctgtatctcgtgtaggtggttctgcacaaatcaaagccatgaagaaggttgctggtacacttcgtatcgaccttgcttcataccgtgagttggaagcctttactaagtttggttctgacttggacgcagcaacacaggctaagttgaaccgtggacgtcgtaccgttgaggtcttgaaacaacctgttcacaaaccattacctgttgagaaacaagtaaccattctttatgctttgacacatggtttcttggatactgttccagtagatgatattgttcgtttcgaggaagagttccatgccttctttgatgctcaacatccagagattttggaaaccattcgtgatacaaaagacttgccagaagaagcagtcttggatgctgcgattacagagtttctcaatcaatctagcttccaataa

SEQ ID NO: 531 - DNA, 567 bp, Streptococcus pneumoniae
tcagtatatcgatcagctaggagaagcttaatggacaagaaaacagtaaaggtaattgaaaaatacagcatgccttttgtccaattggtacttgaaaaaggagaagaagaccgtatcttttcagacttgactcaaatcaagcaagttgttgaaaaaacaggtctgccttcttttttaaaacaagtggcagtagacgagtcggataaggaaaaaacaattgcttttttccaagattctgtgtcgcctttattacaaaactttatccaggttctggcctacaatcacagagcaaatcttttttatgatgtgcttgtagattgcttgaaccgacttgaaaaagaaacaaatcgatttgaagtgacgattacgtctgctcatcctctaactgatgaacagaagactcgtttgctccctttgattgagaaaaaaatgtctctgaaagtaaggagtgtaaaagaacaaatcgatgaaagtctcattggtggttttgtcatttttgccaatcacaagacaattgatgtgagtattaaacaacaacttaaagttgttaaagaaaatttgaaatag

SEQ ID NO: 532 - DNA, 498 bp, Streptococcus pneumoniae
ctgatgcacgtaacagtaggtgaattaattggtaattttattttaatcactggctcttttattcttttgctagtcttgattaaaaaatttgcatggtctaatattacaggcattttcgaagaaagagctgaaaaaattgcttcagatattgacagagctgaagaagcccgtcaaaaagcagaagtattggctcaaaaacgcgaagatgaattggctggtagccgtaaagaagctaagacaatcattgaaaatgcaaaggaaacagctgagcaaagtaaggctaatatcttagcagatgctaaactagaagcaggacacttaaaagaaaaagccaatcaagaaattgctcaaaataaagtagaagctttacagagtgttaagggtgaggtcgcagatttgaccatcagcttagctggtaaaatcatctcacaaaaccttgacagtcatgcccataaagcactcattgatcagtatatcgatcagctaggagaagcttaa

SEQ ID NO: 533 - DNA, 1419 bp, Streptococcus pneumoniae
attgaaagaggtagtgagatggacgcgaaattaagatacaaggcaaagaagatcaagattgtcttttttgatattgatgatacattgcggaattcaaagacagggtttattccaactacaattcccactgtttttaaacagttgcgtgaaaaaggaattttaacaggaatcgcctctggacgtggcatttttggtgttgttccagagattcgtgatctcaagcctgacttttttgtaactttgaatggggcttatatcgaagataaaaaaggtcaggtcatttatcagcatcagattgaaaagtcagatgttgaggagtatatctcttgggctaagcaagaaggaattgagtatggcttggttgggagtcatgatgccaagttgtcgactcgcaccgatatgatgagtgaagctatcaatccaatttatcccgacttagatgtagatcccgatttccatgaaaaagaagatatctatcagatgtggacttttgaagataagggagatgacttgcacttgcctgacagtctctcagacaaacttcgcatggttcgttggcatcaacattcgtctgatattgtgccgatttcaggctccaaagcgacgggggtggaaaaggttgtggaacaccttggcttgaaaccagagaaggtcatggtttttggagatggtctcaacgacttggaactctttgattatgctggaatcagcgttgccatgggaatttctcatgataaaatcaaagaaaaagcagattatattacaaaaacattagaagaagatggcatttttgctgccttagaagtatttggtatggtagaaaaagaattgcattttccacaagtagacattgaaacagtagaaggtcctcttgcgactattaagaccaatcacggagacttacgtatcaagcttttccctgaacatgctcctaaaacagtggctaactttgtatctctttcaaaagatggctactatgatggtgtcattttccaccgtattatcaaggactttatgatccaaggtggagacccaactggaactggtatgggtggcgagtcaatctacggcgaatcttttgaggatgaattctcagaagagctttacaatatccgtggtgctctttccatggcaaatgctggtccaaataccaacggcagccagttctttatcgtgcaaaaccaacacctaccttattctaagaaagaaattactcgtggtggttggccagaaccgattgcagaaatctatgccaatcaaggtgggacacctcacctagaccgccgtcacacggtttttggtcagttagctgatgaagcatcttacgctgtcttggatgccattgctgctgttgagacaggagctatggacaagccagttgaagatgttgtaattgaaactattgaaatcgaggactaa

SEQ ID NO: 534 - DNA, 252 bp, Streptococcus pneumoniae
aggagaaaaaacatggctcaacaacgtcgtggcggattcaaacgccgtaaaaaagttgattacatcgcagcaaacaaaattgaatatgttgattacaaagatactgagcttcttagccgtttcgtttcagaacgtgggaaaatccttcctcgtcgtgtaacaggaacttcagctaaaaaccaacgtaaagtaacaacagctatcaaacgcgctcgcgtaatggctttgatgcctttcgtaaacgaagattaa

SEQ ID NO: 535 - DNA, 312 bp, Streptococcus pneumoniae
accaaaaggaggaacatatcaatggctaaatacgaaattctttatatcattcgtccaaacattgaagaagaagctaaaaacgctttggtagcacgttttgactctattttgactgacaacggtgcaactgttgttgaatcaaaaacttgggaaaaacgtcgtcttgcatacgaaatccaagatttccgtgaaggactttaccacatcgttaacgttgaagcaaatgacgatgcagctcttaaagagtttgaccgtctttcaaaaatcaacgctgacattcttcgtcacatgatcgtcaaaattgacgcgtaa

SEQ ID NO: 536 - DNA, 1638 bp, Streptococcus pneumoniae
gctggatcacttggaaggacgaatcatttaggaggaaagcaaatgaaacgaatagtctttgaacttatttttatcgcaacgacctggtatatctttttaccgccccttaacctgaccagctgggaatttctcttcttcctctgtgggcatttgttagttgtggcaatattatttggctttggcaaggggataaaccttgtcaaaacggttcatgtgcgccacggtaaggcggaagctgccttaaatcttgagggtttcaaaatcaatcggttagggaaaattctgttagcttcgattggaggaattcttctcttggcagctttggtttccttggtaacttccagcatgtttcaggctaaaaattatgccaatgtagtcacggttacggaaaaagactttactgaatttcctaagagtgacaccagtaaggttcctatcctagatagaagtactgctgaaaaaattggagaccgctacttgggttccctaaccgataaggtgtcgcaatacgtagcggcagatacctatacccaattgacaattgatgggaaaccttatcgggtcacaccactagaatatgcagaccctatcaaatggtttaacaatcaagccaagggaatcggtgagtatattaaggtggacatggtaactggaaatgcggatttggtggacttgaagacaccaatcaagtattcagactcggagtattttaaccgtgatgtcaaacgtcacctgcgcttgaagtacccgaccaaaatctttaaaactccatcttttgaggtggacgatgagggcaatcctttctatgtagcaacggtttaccaaaagcaatttggacttgctgttcctcgtcctgcttcagtcattatcttggatgctacaaatggagaaaccaaggaatacagcttatcagatgttccagaatgggtggacaggatctatccagcagaggaaaccattgagcaaatcaactacaacggcaagtacaaggacggtttcttgaatgccatgatttccaagaaaaacgtgacccagactaccaatggctataattacttgtctatcggtaatgacatctatctctacacaggtgtgacgtcggctaatgcggatgagagtaatcttggtttcatccttgaaaatatgcgaacaggagaaatcactaagtatagcttggcttctgcgacagaagaatcagcccgtgaatcagcagaaggtgctgttcaggagaaatcctacaaagcaaccttcccaatcctcatcaacctcaatgacaagcctctctacatcatgggcttgaaggacaatgctggcttggtcaaagagtacgccctggtagacgcagtcgagtaccaaaatgttatcgttgctactacagtggaagagatgctcagcaagtatgccaataaaaacgaccttgaaattgacaatgcaacgacagaaagcatcaatggagtagtagcagacctcaaatcagctgttatcaagggagacactgtctacttctttaaagttgatggcaagatatacaaggtcaaggcttcagtatccgatgaccttccttaccttgaaaatggtaaaaccttcgaaggtcaagtaggaaaagacaattatctcaagacctttaagctacggtaa

SEQ ID NO: 537 - DNA, 2751 bp, Streptococcus pneumoniae
aaagctatgacagaaagagagtctgttttgcacacaatgtcaaggaggagacacatgtcaaaagaacaaaaacgccaagcgttttatactcagagccctgaagaggtcttgcaggctgtggatgcgaccgagcaaggtttgtcatcaagtgaggcggaaaagcgccttgccgaatttgggcacaatgaactcgaagaaggcgagaaacgatcaatcttggtcaaattcatcgagcaatttaaggatttgatgattatcatcctagttgcggcagcaatcttgtcagtcgtgacttctggtggggaagatatcgcagatgccattatcatcctagctgtggttatcatcaacgctgcctttggtgtttaccaagaaggaaaagctgaagaagctattgaagccctcaaatccatgtctagtccagttgcccgcgttcttcgtgatggacacatggcagagattgactctaaagaattggtaccaggcgatatcgttgcccttgaagcaggtgacgtggtaccagcggacctacgtttgatagaagccaactctcttaaaattgaagaagcagccttgacaggtgaatctgtaccagtcgaaaaagacttgtcagtcgagcttgcgacagatgctggtattggtgaccgtgtcaacatggccttccaaaactcaaacgtaacctatggtcgtgggatgggtgttgttgtcaatacaggtatgtacactgaagttggtcatattgctggtatgcttcaagatgcggatgagactgatacaccactcaaacaaaatttgaacaacctttctaaggtcttgacctatgctatcttggtcattgcccttgttacttttgtagtgggtgtcttcattcaagggaaaaatccacttggtgagttgttgacttctgttgcccttgccgttgcagccattccagaaggacttcctgctatcgttaccatcgttctttctcttggtactcaagttttggccaaacgacattccatcgttcgtaagttgccagcagttgaaacacttggttcaactgaaatcatcgcttctgataagactggtacgctgactatgaacaagatgacagtcgaaaaagtcttctacgatgcggttctacatgactcagctgatgatattgaactaggtcttgaaatgccactacttcgttcagttgtcttggccaatgatacgaaaatcgatgtggaaggtaacttgattggtgacccaaccgaaacagcctttatccaatatgccttggacaagggctatgatgtcaaaggtttcttagagaaatatcctcgtgtagctgaattgccatttgactctgaccgtaagctcatgtcaacagttcacccattgccagatggtcgtttccttgtagcagtcaagggtgcgccagaccaactcttaaaacgttgtcttcttcgtgataaggctggggatattgctccgattgatgagaaggttacaaatctcattcgtacaaacaattctgaaatggctcatcaagccttgcgtgtccttgcaggtgcttataagattatcgatagtattccagaaaatctcacttctgaagagcttgaaaatgatttaatttttactggtttgattgggatgattgaccctgaacgtcctgaagccgctgaggctgttcgtgtggctaaggaagcgggaatccgtccaattatgattacaggtgaccaccaagacacagcggaagccattgccaaacgtttgggaatcattgacgcaaacgatacagaaggtcacgttttaactggtgctgaactcaatgaactgtcagatgaagaatttgaaaaagtcgttggtcaatactctgtttatgcccgtgtgtctccagaacacaaggttcgtatcgtcaaggcttggcaaaaacaaggtaaagtcgttgccatgacaggtgacggtgtcaatgacgcgccagctctgaaaacagccgatatcggtatcggtatgggaatcactggtacagaggtttctaagggggcttctgatatgattcttgcagatgataactttgcgactattatcgtcgcagtggaagaaggacgtaaggtcttctcaaacattcaaaagactattcagtacctactttctgctaatactgctgaagtattaaccatcttcctatcaaccttgtttggttgggatgtcttacagccggttcatcttttgtggatcaacttggtaacggataccttcccagctatcgctcttggtgttgaacctgcggaacctggtgtcatgaatcataaaccacgtggacgcaaggcaagcttcttctcaggtggtgttttgagttctatcatttatcaaggtgtactccaagcagctcttgttatgagtgtttatggccttgcgattgcttacccagttcatgtgggtgacaatcatgctattcatgcagatgccctaacgatggcctttgcaacccttggtttgattcagctcttccatgcctacaatgtcaagtctgtctaccaatccatcttgacagttggcccattcaagtctaagacctttaactggtccatcttggtatcctttatccttctcatggcaacaatcgttgtagaaccgcttgaaggaatcttccacgtaaccaaactagacttgtcacaatggggaattgttatggctggaagcttctcaatgattatcatcgtcgaaatcgttaagtttattcaacgcaaactcggttttgacaagaatgcgatttaa

SEQ ID NO: 538 - DNA, 891 bp, Streptococcus pneumoniae
gacgaaagtgttttgatagggaggatatcagggatgaattttcaacaattatccaatctgcaatattggaccagtttgtttgcaagtccatggacgatagctatcaatctgattgatattttgattgttgcttatattttataccattttacaaaagctattgcaggaaccaagattatgattttggtacgtggagttttggtgtttattttagctcaaatccttgcaaatatgattggtttgactacgatttcttggttaatcaatcaaattattacttatggggttattgcggcggttgttatcttctctccagagattcggactggtttggaacgtttgggaagagcgacagatttcttttccaatgcccctattagtgctgaggaacagatgattcgtgcctttgttaagtctgttgaatacatgagtcctcgtaaaatcggggccttggttgctattcagcgtgtacgtaccttgcaggagtatatttcgacaggaattcccttggatgctaagatttctgcagaacttctcattaacatttttattcccaacactcccctacatgatggtgcggtgattatcaaagaagaacgtatcgctgtgacgtctgcctatctgcccttgacaaaaaacacagggatttccaaggaatttgggaccagacaccgggcggctatcggtttatcagaagtctcagatgccttgacttttgtcgtatcagaggaaacgggaggaatttcgataacctataatggaaggtttaagcacaacctaacacttgatgaatttgaaacagaattacgtgaaatcttacttccaaaagaggaagtgggtcttagttttaaagaacgattgctaggaggatggaaacatgaaaaaaaatag

SEQ ID NO: 539 - DNA, 1260 bp, Streptococcus pneumoniae
aatgacagtatagaatggaaggaaatcatgtctacaaatagaaaaaatgatatgatggtttattgctcattttgtggcaaaaaccaagaagaagtacaaaaaataattgctggcaacaatgcttttatttgtaatgaatgcgtggagttagctcaggaaatcattcgagaagaattggttgaggaagtcttggcagacttgtctgaggtgccaaaaccaattgaactcctccatatcttgaaccactatgtaattggtcaagatcgtgccaagcgtgccttggcagtggcggtttataaccactacaaacgcatcaatttccacgatacacgcgaagagtcagaagatgtggatttgcagaagtcaaacattttgatgattggcccaactggttcagggaaaactttccttgcccagaccttggctaagagcttgaatgtaccttttgctattgcggatgcgacagctctgacggaggctggttatgtgggtgaggatgtggaaaatatcctcctcaaactcttgcaggttgctgactttaacatcgaacgtgcagagcgtggcattatctatgtggatgaaattgacaagattgccaagaagagtgagaatgtgtctatcacacgtgatgtttctggtgaaggggtgcaacaagcccttctcaagattattgagggaactgttgctagcgtaccgcctcaaggtggacgcaaacatccacaacaagagatgattcaagtggatacaaaaaatatcctcttcatcgtgggtggtgcttttgatggtattgaagaaattgtcaaacaacgtctgggtgaaaaagtcatcggatttggtcaaaataataaggcgattgacgaaaacagctcatacatgcaagaaatcatcgctgaagacattcaaaaatttggtattatccctgagttgattggacgcttgcctgtttttgcggctcttgagcaattgaccgttgatgacttggttcgcatcttgaaagagccaagaaatgccttggtgaaacaataccaaaccttgctttcttatgatgatgttgagttggaatttgacgacgaagcccttcaagagattgctaataaagcaatcgaacggaagacaggggcgcgtggacttcgctccatcatcgaagaaaccatgctagatgtcatgtttgaggtgccgagtcaggaaaatgtgaaattggttcgcatcactaaagaaactgtagatggaacggataaaccgatcctagaaacagcctag

SEQ ID NO: 540 - DNA, 1164 bp, Streptococcus pneumoniae
tataattatcaaaagacaaaaggagttcacctcatggtagaattgaatcttaaaaatatttacaaaaaatatccaaacagcgaacactattcagttgaagatttcaacttgaacatcaaagataaagaatttatcgttttcgtaggaccttcaggatgtggtaaatcaactacactccgtatgattgctggtcttgaagacattacagaaggtactgcatctatcgatggcgtagttgtcaacgacgtagctccaaaagaccgtgatatcgccatggtattccaaaactacgctctttacccacacatgactgtttatgacaacatggctttcggtttgaaattgcgtaaatacagcaaagaagacattaacaaacgtgttcaagaagcagctgaaatacttggattgaaagaattcttggaacgtaaaccagctgacctttcaggtggtcaacgtcaacgtgttgccatggggcgtgcgattgtccgtgatgcgaaagtattcttgatggacgaacctttgtcaaacttggatgccaaacttcgtgtatcaatgcgtgctgaaatcgctaaaattcaccgtcgtatcggagctacaactatctatgtaactcacgaccaaacagaagcgatgacacttgcagaccgtatcgttattatgtcagctactaagaaccctgctggtacaggtactatcggacgtgtagaacaaatcggtactcctcaagaagtttacaaaaatccagttaacaaattcgttgcaggattcatcggaagcccagctatgaacttcatcaccgtgaaattggttggtagcgaaattgtttctgacggtttccgtttgaaagtgccagaaggagcattgaaagttcttcgtgaaaaaggctacgaaggaaaagaattgatctttggtatccgtccagaagacgtgaatgcagaacctgctttccttgaaacattcccagactgtgttgtaaaagcgactatctctgtatcagaactgcttggttcagaatctcacctttactgtcaagttggtaaagacgagtttgttgcaaaagttgatgctcgtgactacttgcaaacaggtgcaacagttgagcttggatttgacttgaacaaagcacacttcttcgatgtagaaactgaaaaaacaatctactaa

SEQ ID NO: 541 - DNA, 1638 bp, Streptococcus pneumoniae
aaagaaaagtataaactaagccctatagggtggcttcgcaccacctttagaaagaagaataacgtgaaatttaatgaattaaacttgtctgctgatttgctagcagaaattgaaaaagctggttttgtagaagctagtcctatccaagaacaaactattcctttggcccttgaaggcaaggatgttatcggtcaagctcagactggtacaggaaaaactgcagcctttggcttgcctacccttgaaaaaatccgtacagaagaagcgactatccaagccttggtcatcgctccaactcgtgaactagctgtccaaagtcaagaagaactcttccgctttggtcgtagtaagggagtcaaagtccgttcagtatatggcggatcaagcattgaaaaacaaattaaggctcttaaatctggtgcccatattgtggtgggaactccaggtcgcctcttggacttgattaaacgcaaggccttgaaattacaagacattgaaacccttatccttgacgaagcggatgaaatgcttaacatgggcttccttgaagacatcgaagccattatttcccgtgtacctgagaaccgtcaaactttgcttttctcagcaactatgccagatgccatcaaacgtatcggtgttcagtttatgaaagcccctgaacatgtcaagattgcggctaaggaattgacaacagaattggttgaccagtactatatccgtgttaaggaacaagaaaaatttgacaccatgactcgtctcatggatgtggcacaaccagaactcgctattgtatttggtcgtaccaaacgccgtgtggatgaattgactcgtggtttgaaaattcgtggcttccgtgcagaaggaattcatggcgacctagaccaaaacaaacgtcttcgtgtccttcgtgactttaaaaatggcaatcttgatgttttggttgcgacagacgttgcagcgcgtggtttggatatttcaggtgtgacccatgtctacaactacgatattccacaagatcctgagagttatgttcaccgtatcggtcgtacaggtcgtgctggtaagtcaggtcaatctattacttttgttgctccaaacgaaatgggttaccttcaaatcattgaaaacttgactaagaaacgcatgaaaggtctcaaacctgcaagtgtagaagaatccttccaatcaaaaaaacaggtagctctcaagaaaatcgaacgtgattttgcagatgaaaccattcgtgccaactttgagaaatttggtaaggatgctcgcaaattggctgctgagtttactccagaagaattggcaatgtatatcttgagtctgacagtccaagacccagatagccttccagaagtggagattgcacgtgaaaaaccactaccgtttaaaccatcaggtaatggtttcggtggtaaagctaagggaggtcgtggaggccgtcgtggggacgaccgtcgagagcgtgatcgccgtggcaatggtcgccgtgatgagttcaaaaaaggaagtcgtggcaacgatcgttttgataaggaaaaacgttaccgtaaggataataaaaaaccacgcaatactttaagcgaaaagcaaacaggctttgttattcgtaacaaaggcgataaataa

SEQ ID NO: 542 - DNA, 1317 bp, Streptococcus pneumoniae
atgttaacatacgatttaattgttattggatttggtaaagctggtaaaacactagcaggtaaattggcttcagctggcaaaaaagttgccctcgttgaacgcagcaaggctatgtacggtggaacttgtatcaacattggttgtatcccaactaaaaccttgctagttgctgctgaaaaggacttgtcttttgaagaagtcattgctactaaaaacacgatcactggtcgcctcaacggtaaaaactatgcgactgttgctggtacaggcgtagatatctttgatgcggaagctcacttcctttcaaataaagtcatcgaaatccaagctggtgatgaaaagaaagaactgactgctgaaacaatcgtcatcaacactggtgctgtttcaaacgtcttgccaatccctggacttgctacaagcaaaaacatctttgactcaacaggtatccaaagcttggacaaattacctgaaaaacttggaatccttggtggcggaaatatcggtcttgaatttgccggcctttacaacaaacttggaagcaaggtcacagtcctagatgccttggatacattcctacctcgtgcagaaccttccatcgcagctcttgctaaacaatacatggaagaagatggcattgaattgcttcaaaatatccatactactgaaatcaaaaacgatggtgaccaagtgcttgtcgtaactgaagacgaaacttaccgtttcgacgcccttctctacgcaactggacgcaaaccaaatgtagaaccacttcaacttgaaaatacagatattgaactaactgaacgtggtgctattaaagtagacaaacactgtcaaacaaacgttcctggtgtctttgcagttggagatgtcaacggtggccttcaatttacttacatttcacttgatgacttccgtgttgtttacagctaccttgctggagatggcagctatacacttgaagaccgtctcaatgtgccaaatactatgttcatcacacctgcactttcacaagttggtttgactgaaagccaagcagctgatttgaaacttccatacgctgttaaggaaatccccgttgcagcaatgcctcgtggtcacgtaaatggagaccttcgcggtgccttcaaagctgttgtcaatactgaaacaaaagaaattcttggagcaagcatcttctcagaaggttctcaagaaatcatcaacatcatcactgttgctatggacaacaagattccttacacttacttcacaaaacaaatcttcactcacccaaccttggctgagaacttgaatgacttgtttgcgatttaa

SEQ ID NO: 543 - DNA, 2370 bp, Streptococcus pneumoniae
aattctgttaaaaaaaatgatataatagaatttatggataaaaataagattatgggattaacccaaagagaagtcaaggaaagacaggctgagggtttggtcaatgactttaccgcatcagccagtaccagcacttggcaaatcgttaaacgaaatgtctttaccctttttaacgctttgaactttgccattgctttggctcttgcctttgtgcaggcttggagcaatctggtcttctttgctgttatctgctttaacgctttttctgggattgtgaccgagctacgagccaaacacatggtggacaagctcaatctcatgaccaaggaaaaggtcaaaaccatccgtgatggtcaggaagttgctcttaatcctgaagaattagtgctaggagatgtcattcgtttgtctgcaggagagcagattcctagtgatgccttggttttggaaggctttgcggaagtcaatgaagccatgttaacgggagaaagtgatttggtgcaaaaggaagttgacggcttacttttgtcaggaagtttcctagccagtgggtcagttttatctcaagttcaccatgtcggtgcagacaactatgctgccaaactcatgcttgaggctaagaccgttaaacccatcaactcccgtatcatgaaatcgctggacaagttggctggttttactgggaagattatcattccctttggtctggctctcttgctggaagccttgcttttaaaaggcctgcctctcaagtcatccgttgtaaactcgtcgacagctcttttgggaatgttgcctaagggaattgcccttttgaccattacttcgctcttgactgcagtgattaagttgggcttgaaaaaggtcttggtgcaggagatgtactctgttgagaccttggcgcgcgtggatatgctctgtctggacaagacgggtaccatcacccaaggaaagatgcaggtggaggctgttcttccgttgacggaaacgtatggtgaagaggctattgccagcatcttgactagctacatggcccatagtgaggataagaatccaactgcccaagccattcgccagcgttttgtgggagatgttgcttatcctatgatttccaatcttcccttctcgagcgaccgcaagtggggggctatggagttagaaggcttggggacagttttcttaggggcacctgagatgttgcttgattctgaagtcccagaagctagggaggccttggagagaggatcacgtgtcttggtcttagctctcagtcaggagaaattagaccatcacaaaccacagaaaccatctgatattcaggctctagccttgctggaaatcttggaccccattcgagagggagcagcagagacgctggactatctccgttctcaggaggtgggactcaagattatctctggtgacaatccagttacggtgtccagcattgcccagaaggctggttttgcggactatcacagctatgtagattgctcaaaaatcaccgatgaggaattgatggccatggcggaggagacagctattttcggacgtgtttcccctcatcaaaagaaactcatcatccaaacgttgaaaaaagcgggacatacaacggctatgacaggggacggggttaatgatatcttggcccttcgtgaggcggattgttctatcgtgatggcggagggggatccagcaacccgtcagattgccaatctggttctcttgaactcagactttaatgatgttcctgagattctcttcgagggtcgtcgcgtggtcaataacattgcccacatcgccccgattttcttgataaagaccatctattccttcctgttagcagtcatctgtattgccagtgctttactaggtcggtcagagtggattttgattttccccttcattccgatccagattaccatgattgaccagtttgtggaaggtttcccaccattcgttctgacttttgagcgaaatatcaaacctgttgagcagaatttcctcagaaaatccatgcttcgtgccctaccaagcgctctcatggtcgtcttcagcgtcctgtttgtgaaaatgtttggcgcgagtcaaggttggtctgagttagaaatctcaactctactctattatctcttggggtcaattggtttcttatccgtatttagagcctgcatgccatttaccctatggcgtgtcctcttgattgtttggtcagtaggaggtttcctagccacagctctcttcccaagaattcaaaaactgcttgaaatttcaaccttaacagaacaaacgttgcctgtttatggtgtcatgatgttggtctttaccgtgattttcatcctgaccagtcgttaccaagcgaaaaaataa

SEQ ID NO: 544 - DNA, 294 bp, Streptococcus pneumoniae
agccaaataaaaaggagaaacatcatggcaatctcaaaagagaaaaaaaatgaaatcatcgcacaatatgcacgtcacgaaggtgatacaggttcagtagaggttcaagttgctgtccttacttgggaaatcaaccaccttaacgaacacatcaaacaacacaaaaaagaccacgctacttaccgtggattgatgaaaaaaatcggtcgccgtcgtaacttgcttgcatacttgcgtaaaaacgacgttaaccgttaccgtgagttgatcaactctctaggacttcgtcgctaa

SEQ ID NO: 545 - DNA, 1953 bp, Streptococcus pneumoniae
ttgcattccctagtgatttttgttaagataaatgcaaatacaaatgaaagcgagaacaagatgacacgttatcaagatgatttttatgatgctatcaatggagaatggcaacagacagctgaaatcccagcagataagtctcaaacaggaggttttgttgatttagaccaggaaattgaagacctgatgctggcgacaacagacaagtggttagcaggtgaagaagtgcctgaggatgctatcttggaaaactttgtcaaataccaccgcctagttcgtgattttgacaagagagaagctgacggtatcacacctgtcttaccactccttaaagaattccaagaattggagacttttgcggattttacagctaaactagcagagtttgagcttgcaggaaaaccaaacttccttccttttggtgtatcgccagactttatggatgctagaatcaatgttctatgggctagcgctccaagcacaatcttgccagatacgacctactatgcagaagaacatcctcagcgcgaagagctcttgactctttggaaagaaagcagcgcaaatctcctcaaggcttatgatttctctgatgaagaaattgaagacttgctagaaaaaagacttgaattggaccgccgagttgcggcagtggtgctctctaatgaagaaagttcagaatatgctaaactctatcatccatattcttacgaagatttcaagaaattcgcgcctgccctacctttggatgacttcttcaaagcagttattgggcaattaccagacaaggttattgtagacgaggaacgtttctggcaagcagcagagcaattctacagtgaggaagcctggtctctccttaaagcaaccttgattttgagtgttgtcaatctttcaaccagctatttaacagaggatatccgtgttttgtctggtgcctacagccgtgccctttctggagttccagaggcaaaagataaggtcaaagcagcttatcatctagcacaagaacctttcaagcaagccctgggtctttggtacgcccgtgagaagttctctccagaagccaaggcggatgtggagaaaaaagtggcaaccatgattgatgtttataaggagcgtctgcttaagaatgactggctcactccagaaacctgtaaacaggctatcgtgaagctcaatgtgatcaaaccttatattggctatccagaagaattgcctgcacgttacaaggataaggtagtgaatgaaactgccagtctttttgagaatgctctagcctttgcgcgtgtggaaatcaagcacagttggagtaagtggaaccagcctgtagattataaggaatggggcatgcctgctcatatggtcaatgcctactacaatcctcagaagaacctgattgtctttccagcggccattttacaggcgcctttctatgacttgcatcagtcatcttctgctaactacggtggtattggggcagtgattgcccatgaaatttcccacgcctttgatactaacggggcttcctttgacgaaaatggtagcctcaaggattggtggacagagagcgactatgctgccttcaaggagaaaacacaaaaagtcattgaccaatttgatggacaggattcttatggagcaaccattaacggtaaattgactgtatcagaaaacgtggctgacttgggaggaatcgcagcagcgcttgaagcagctaagagagaagcagacttctcagcagaagagttcttctacaacttcggtcgcatctggcgcatgaaaggtcgaccagaatttatgaaacttttggctagcgtcgatgtgcacgcaccagccaaactccgtgtcaatgtgcaagtaccaaacttcgacgatttctttacaacctatgatgtcaaagaaggagacggaatgtggcgttcaccagaggagcgcgtgattatttggtaa

SEQ ID NO: 546 - DNA, 708 bp, Streptococcus pneumoniae
aggagaatccatctaatggtaaaattggtttttgctcgccacggtgagtctgaatggaacaaagctaaccttttcactggttgggctgatgttgatttgtctgaaaaaggtacacaacaagcgattgacgctggtaaattgatcaaagaagctggtatcgaatttgaccaagcttacacttcagtattgaaacgtgctatcaaaacaactaacttggctcttgaagcttctgaccaattgtgggttccagttgaaaaatcatggcgcttgaacgaacgtcactacggtggtttgactggtaaaaacaaagctgaagctgctgaacaatttggtgatgagcaagttcacatctggcgtcgttcatacgatgtattgcctccaaacatggaccgtgatgatgagcactcagctcacacagaccgtcgttacgcttcacttgacgactcagttatcccagatgctgaaaacttgaaagtgactttggaacgtgctcttccattctgggaagataaaatcgctccagctcttaaagatggtaaaaacgtattcgtaggagctcacggtaactcaatccgtgcccttgtaaaacacatcaaaggtttgtcagatgacgagatcatggacgtggaaatccctaacttcccaccattggtattcgaattcgacgaaaaattgaacgtcgtttctgaatactaccttggaaaataa

SEQ ID NO: 547 - DNA, 549 bp, Streptococcus pneumoniae
gagagaaccatgtctttaaaagatagattcgatagatttatagattattttacggaggatgaggattcaagtctcccttatgaaaaaagagatgagcctgtgtttacttcagtaaattcttcacaggaaccggctctcccaatgaatcaaccttcacagtcggctggcacaaaagagaacaatatcaccagacttcatgcaagacaacaggaattggcaaatcagagtcagcgtgcaacggataaggtcattatagatgttcgttatcctagaaaatatgaggatgcaacagaaattgttgatttattggcaggaaacgaaagtatcttgattgattttcagtatatgacagaggtgcaggctcgtcgttgtttggactatttggatggagcttgtcatgttttagctggaaatttgaaaaaggtagcttctaccatgtatttgttgacaccagtgaacgttattgtaaatgttgaagatatccgtttaccagatgaagatcaacagggtgagttcggttttgatatgaagcgaaatagagtacgataa

SEQ ID NO: 548 - DNA, 1389 bp, Streptococcus pneumoniae
agaggaagcgatgtaatggctagagaaggcttttttacaggtctagatattggaacaagctctgtcaaggtgcttgtggccgagcagagaaatggtgaattaaatgtaattggcgtgagtaatgccaaaagtaaaggtgtaaaggatggaattattgttgatattgatgcagcagcaactgctatcaagtcagccatttcccaagcggaagaaaaggcaggcatttcgattaaatcagtgaatgtcggcttgcctggtaatcttttgcaggtagaaccaactcaggggatgattccagtaacatctgatactaaggaaattacggatcaagatgttgaaaatgttgtcaaatcagctttgacaaagagtatgacacctgaccgtgaagtcattacctttattcctgaagaatttattgtggatggtttccaagggattcgtgacccacgtggcatgatgggggttcgccttgaaatgcgtggtttgctttatacaggacctcgtactatcttgcacaatttgcgtaagacggttgagcgtgcaggtgttcaggttgaaaatgttatcatttcaccactagcaatggttcagtctgttttgaacgaaggggaacgtgaatttggtgctacagtgattgatatgggggcaggtcaaacgactgtcgctacaatccgtaatcaagaactccagttcacacatattctccaagaaggtggagattatgtaactaaagatatctccaaggttttgaaaacctctcgcaaattagcggaaggcttgaaactgaattacggggaagcctatccgcctcttgcaagcaaagaaaccttccaagtagaggttattggagaagtagaagcagtcgaagtgacggaagcctacttgtcagaaattatttctgcacgaatcaagcacatccttgaacaaatcaagcaagaattagatagaaggcgtctattggacctccctggtggtattgtcttaatcggtgggaatgccattttaccaggtatggttgagcttgctcaggaagtctttggcgtccgtgtcaagctttatgttccaaatcaagttggtatccgtaatccagcctttgcgcatgtgattagtttatcagaatttgcgggtcaattaacagaagttaatcttttggctcagggagcgataaaaggtgagaatgacttaagtcatcagccaattagttttggtgggatgctgcaaaaaacagctcagtttgtacaatcaacgcctgttcaaccagctcctgctccagaagtagagccggtggcgcctacagaaccaatggcggatttccaacaagcttcacaaaataaaccgaaattagcagatcgtttccgtggattgatcggaagcatgtttgacgaataa

SEQ ID NO: 549 - DNA, 2073 bp, Streptococcus pneumoniae
gattttaagttagaaatgagactgatttgtatgagaaaatttaacagccattcgattccgattcggcttaatttattgttttcaatcgtcattttactctttatgaccattattggtcgtttgttgtatatgcaggttttgaacaaggatttttacgaaaaaaagctagcttcagctagtcagaccaagattacaagcagttcagcccgtggggaaatttatgatgctagtggaaaacctttggtagaaaatacgttaaagcaggttgtttcctttacgcgtagcaataaaatgacggctacagacttaaaagaaacagctaaaaagttactgacttatgtgagcatcagttctccaaatttgacagaacgccagctggcggattactatttggctgatcctgaaatctataaaaaaatagtggaagctctcccaagtgagaaacgcttggattcagatggcaatcgtctatccgaatcagaactgtataacaatgcggtcgatagtgtacaaacgagtcaactaaactatacagaggatgaaaagaaagaaatctatctttttagtcagttaaatgctgttggaaactttgcgacaggaaccattgcgacagatcctctaaatgattctcaggtggctgttattgcctctatttcaaaggagatgcctggcattagtatttctacttcttgggatagaaaggttttggaaacttccctttcttctatagttgggagtgtatccagtgaaaaagctggtctcccagcggaagaagcagaagcctatcttaaaaaaggctattctctaaatgaccgtgtaggaacctcctatttggaaaagcaatatgaagagaccttacaaggaaaacgctcggtaaaagaaatccatctggataaatatggcaatatggaaagcgtggatacaattgaggaaggtagtaagggaaacaatatcaaactgaccattgatttggctttccaagatagcgtggatgctttactgaaaagttatttcaattctgagctagaaaatggtggagccaagtattctgaaggtgtctatgcagtcgcccttaacccaaaaacaggtgcggttttgtctatgtcagggattaaacatgacttgaaaacgggagagttgacgcctgattccttgggaacggtaaccaatgtctttgttccaggttcggttgtcaaggcggcgaccatcagctcaggttgggaaaatggagtcttgtcaggaaaccagaccttgacagaccagtccattgtcttccaaggttcagctcccatcaattcttggtatactcaggcttacggttcattccctatcacagcggtccaagctctggagtattcatcaaatacctatatggtccaaacagccttaggtcttatggggcaaacctatcaacccaatatgtttgtcggcaccagcaatctagagtctgctatggagaaactgcgttcaacctttggcgaatatggcttgggtactgcgacaggaattgacctaccagatgaatctactggatttgttcccaaagagtatagctttgctaattacattactaatgcctttgggcagtttgataactatacgccgatgcagttggctcagtatgtagcaactattgcaaataatggtgttcgtgtggctcctcgtattgttgaaggcatttatggtaataatgataagggaggactgggtgacttgattcagcaactgcaaccgacagagatgaataaggtcaatatatccgactccgatatgagcatcttgcaccaaggtttttatcaggttgcccatggtactagtggattgacaactggacgtgccttttcaaatggtgccttggtatccattagcggaaaaacaggtacagccgaaagctatgtggcagatggtcagcaagcaaccaataccaatgcggtggcctatgccccatctgataatccccaaatcgctgtcgcagtggtctttcctcataataccaatctaacaaatggtgtaggaccttccattgcgcgtgacattatcaatctgtatcaaaaataccatccaatgaattag

SEQ ID NO: 550 - DNA, 930 bp, Streptococcus pneumoniae
aatgaagaatatagagatagagtaatgagtgaattaattagtgttgtggtaccgatatacaatacgggaaaatatttagtggagtgtgtcgagcatattctgaagcaaacctatcaaaatatagaaattattttagttgatgacggttctacggataattctggggaaatttgtgatgcttttatgatgcaagataatcgtgtgcgagtattgcatcaagaaaataaggggggggcagcacaagctaaaaatatggggattagtgtagctaagggagagtacatcacgattgttgattcagatgatatcgtaaaagaaaatatgattgaaactctttatcagcaagtccaagaaaaggatgcagatgttgttatagggaattactataattatgacgaaagtgacgggaatttttatttttatgtaacagggcaagatttttgcgtcgaagaattagctatacaagaaattatgaaccgtcaagcaggagattggaaattcaatagctcggcctttatattgccgacatttaagttgattaaaaaagaattattcaatgaagttcacttttcaaatggtcgccgctttgatgatgaagcaactatgcatcgcttttatcttttagcctctaaaatcgtctttataaacgataatctctatctgtatagaagacgttcaggaagcatcatgagaacggaatttgatctttcctgggcaagagatattgttgaagtgttttctaagaaaatatcggattgtgtcttggctggtttggatgtctccgttctgcgtattcgatttgtcaatcttttaaaagattataagcaaactttagaataccatcaattaacagatactgaggaatataaagatatttgtttcagattaaagttgttttttgatgcagaacaaagaaatggtaaaagttga

SEQ ID NO: 551 - DNA, 345 bp, Streptococcus pneumoniae
gccaatataactaaaaaaaggagaaatacaatggcaaaagcaattacagatgcaacattcgaacaagaaacaaaagacggtttggtcttagtagacttctgggcaacttggtgtggtccatgtcgtatgcaaggtccaatcttggacaaattgtctgaagaactttcagaagatgtcttgaaaatcgttaaaatggacgttgatgaaaatccaaacacagctcgtgcttttggaatcatgtctattccaactcttctcttcaaaaaagacggccaagttgtcaaacaagttgcaggtgttcacacagcagaacaaatcaaggccatcattgctgaattgagctaa

SEQ ID NO: 552 - DNA, 624 bp, Streptococcus pneumoniae
ttaaaggagtttcatatgtcaaacgaaaaaaacacaaacactaacgtagaaaagaaagatgctactgttgtagctcacgaaatcaaaggggaacttacttacgaagataaagttatccaaaaaatcattggtctttcactagaaaacgtttcaggtcttttgggaatcgatggtggtttcttctcaaatcttaaagaaaaaatcgttaacagcgatgacgtaacaagtggtgttaacgtagaagttggtaaaacacaagttgcagttgacttaaacgttattgttgagtaccaaaaaaatgttccagctttatattcagaaatcagagaaatcgtatcttcagaagttgctaaaatgactgacttggaaattgttgaaatcaacgtaaacgttgtcgacatcaaaactaaagaacagcatgaagcagactcagtaagccttcaagatcgcgtatctgacgttgctgaatcaacaggagaattcacttcagaacaattcgaaaaagctaaatctggtcttggatctggtttctcaactgttcaagaaaaagttagcgaaggtgtagaagctgttaaaggtgcagcaaatggtgtagtatctcacgaaaacactcgtgtaaactaa

SEQ ID NO: 553 - DNA, 1764 bp, Streptococcus pneumoniae
aaggagaagaagatgcagaataaacaagaacaatggactgtattgaagcgcttgatgtcttatctcaagccttatggactcctgacctttttggcactcagttttctcctagcgacgacggtcattaaaagtgtcatacccctcgtggcttcccactttatcgaccagtatctcagcaatcttaaccaactagccgttaccgttttgctggtctactatggtctctacatcctacaaactgtagttcagtatgtcggcaatcttctctttgcgcgcgtgtcttacagtattgttagggatattcgtcgggatgcctttgccaatatggagaaactgggcatgtcttactttgacaagacgccagcaggttctatcgtttctcgtttgaccaacgataccgagacgattagtgatatgttttctgggattttatccagctttatctcagcagtttttatctttctgacaaccctttataccatgttggtgctggattttcgtttgacggctttagtcttgctctttcttcctttgattttccttttggtcaatctctatcgaaaaaagtcagtgaaaatcatcgagaaaaccagaagtctcttgtcagatatcaatagtaagctggcagagaatatcgagggaatcaggattattcaggcctttaatcaagagaagcgcctgcaggcagaatttgatgaaatcaaccaagaacacttggtctacgccaaccgttctgtagccttggatgccctctttttgagacctgccatgagtttgctgaaacttctaggctatgcagtcttgatggcctactttggctaccgtggtttttctatcgggataacggtcgggaccatgtatgcctttatccagtacatcaaccgcctttttgaccccttgattgaggtgacgcaaaacttttcaactctgcaaacggctatggtttctgcaggtcgtgtctttgccctgatagacgagaggacctatgaacctcttcaagaaaatgggcaagccaaagtccaagaaggcaatatccgttttgaacatgtgtgtttctcatatgacggtaaacatccgattctggatgacatttctttctctgttaataagggtgaaaccattgcctttgtaggtcatacaggttcagggaaatcgtctattatcaatgtcctcatgcgcttttatgaattccagtcagggagagttctcttggatgatgtggatatcagggatttcagtcaagaagagctgagaaaaaacatcggtttggtcttgcaggaacccttcctctatcatggaactattaagtccaatatcgccatgtaccaagaaaccagtgatgagcaggttcaggctgcggcagcctttgtggatgcagattcctttattcaagaacttcctcaggggtacgactcccctgtttccgagcgtggttcgagcttctctactgggcaacgccagcttcttgcctttgctagaacagtcgccagccagcctaaaatcctgattttggatgaagcgacagccaatattgactctgaaacagaaagcttggttcaagcttctctggcgaagatgagacagggccgaacaactattgctatcgctcaccgcctttctactattcaagatgccaactgcatctatgtcttggataagggacgcattatcgagagtggaacccatgaggaactcttggctctgggaggaacctatcacaagatgtatagtttgcaggcaggggccatggccgatactctttga

SEQ ID NO: 554 - DNA, 480 bp, Streptococcus pneumoniae
aggaaagtatcggaaattatgaaaacgaaacaacttgttgcatcagaagaggtgtatgatttcttaaaagtcatctggcctgattatgaaactgaaagccgttacgataacctaagtttaatcgtctgtaccttatcagatcccgattgtgtgagatggttatctgaaaatatgaaatttggtgacgaaaaacaactagctttgatgaaggaaaaatatgggtgggaagtaggagataaattgccagagtggctacatagctcctatcatagattattgttaataggtgaattattggaaagcaatctaaaactgaaaaagtatacagtagaaattacagaaactttatcacgtttagtaagtatagaggctgaaaatccagatgaagccgaacgacttgtaagagaaaagtataagagttgtgaaattgttcttgatgcagatgattttcaggactatgacactagcatatatgaatag

SEQ ID NO: 555 - DNA, 1014 bp, Streptococcus pneumoniae
agaatggctggaaaaagagattcatgtggagcatgtagaattatgacaaataaaatttatgaatataaggatgaccaggactggtatgttgggtcttatagtatttttggtggcgttaacagtttgagcgactataagacagattttcctctgtttgaattctccaaaatatttggagatgaagagtatggtttcccgctttcagttactgttttacgctatggttctatctaccgtttgttctcctttgtggtagacatgcttaatcaagaaatgggacgaaacttggaagttattcaacgtcatggggccctgctcttggttgaaaatgggcaactcttgtatgtagaattgcctaaagaaggggtcaatgttcatgatttctttgagacaagcaaggtcagagaaaccttgttgattgcgactcgtaacgaaggtaaaaccaaggaattccgagctatctttgataagttaggctacgatgtggaaaatcttaatgactaccctgacctgcctgaagtagcagaaacaggtatgacctttgaagaaaatgcccgccttaaggcagaaaccatttctcaattaacgggcaagatggttttggcagatgattctggtctcaaagtcgatgtccttggtggcttaccaggcgtctggtcagctcgtttcgcaggtgtgggagcaactgaccgtgaaaataatgccaaactcttgcacgaattggccatggtctttgaactcaaggaccgctcggctcagttccacacaaccctagtcgtagccagcccaaataaggaaagtttagttgttgaagcagactggtcaggttatattaactttgaacctaagggtgaaaatggctttggctatgatcccctcttccttgtaggagaaacaggtgagtcatcagctgaattaaccctggaagaaaaaaatagtcaatctcaccgtgccttagccgttaagaaacttttggaggtatttccatcatggcaaagcaaaccatcattgtaa

SEQ ID NO: 556 - DNA, 318 bp, Streptococcus pneumoniae
aacaaactggtcagggtggctagtttgtggtataatgaaagggactcaaaaagaaacaggagaaaaatgatggatttacttttagcaattgtattgattgtgctagcttttctaggaggagctctaggaggaatgtacttggttcgtaagcaaatcgaaaaagaatttgctgacaacccacgtttgaatgctgaagcagttcgtactcttttgagtgcaaatggtcaaaaaccaagcgaagctaaggtacaacaagtttaccaccaaatcatccgccaacaaaaggcagcccttgctaacaataaaaagaaaaaataa

SEQ ID NO: 557 - DNA, 312 bp, Streptococcus pneumoniae
tatctatctcattatggaggaaatcagatgttgaaaccattaggggaccgtgtggtcttaaaaatagaagaaaaagaacaaactgttggaggctttgtccttgcaggctcagcccaagaaaaaaccaaaacagctcaagttgtggctactggacaaggtgttcgtaccttgaacggtgacttggttgctccaagtgttaaaactggagatcgtgtcttagttgaagcccacgcaggtcttgatgtcaaagatggcgatgaaaagtacatcatcgtaggcgaagctaacattttggcaatcattgaggaatag

SEQ ID NO: 558 - DNA, 477 bp, Streptococcus pneumoniae
atgaaaggagttacgaatatgacgccagaagaaatgtacctgacagagcgattagacgtacagatagctcattttttaaagaaaagcgttcaacatcgtaggcgctataaggtattaaaaataacagaaatcgtggcaggtttcctcatagctgtcttttgtgctattcctatgccaggtgatcgctaccgtttgatttcggttgccttatccagtctcggcttgctgtgtgaggggattatcaatttgtataatgcaaaggaaaattggatttcttaccaaaaaactgcgcaactcctggagaaagaaaaattcctctatcaatgccaaacggagaaatatgcaggaaagaccaaggcttttgccctatttgtcaagacatgcgaaggtcttatctcagaggagattaaccagtgggaaagtatccagtcaaaagaagtggcagctagtgcagatgctccagttaaaaaagagtag

SEQ ID NO: 559 - DNA, 1176 bp, Streptococcus pneumoniae
gagaatagaatggcgaaaaaaccaaaaaaattagaagaaatttcaaaaaaatttggggcagaacgtgaaaaggccttgaatgacgctcttaaattgattgagaaagactttggtaaaggatcaatcatgcgtttgggtgaacgtgcggagcaaaaggtgcaagtgatgagctcaggttctttagctcttgacattgcccttggctcaggtggttatcctaagggacgtatcatcgaaatctatggcccagagtcatctggtaagacaacggttgcccttcatgcagttgcacaagcgcaaaaagaaggtgggattgctgcctttatcgatgcggaacatgcccttgatccagcttatgctgcggcccttggtgtcaatattgacgaattgctcttgtctcaaccagactcaggagagcaaggtcttgagattgcgggaaaattgattgactcaggtgcagttgatcttgtcgtagtcgactcagttgctgcccttgttcctcgtgcggaaattgatggagatatcggagatagccatgttggtttgcaggctcgtatgatgagccaggccatgcgtaaacttggcgcctctatcaataaaaccaaaacaattgccatttttatcaaccaattgcgtgaaaaagttggagtgatgtttggaaatccagaaacaacaccgggcggacgtgctttgaaattctatgcttcagtccgcttggatgttcgtggtaatacacaaattaagggaactggtgaccaaaaagaaaccaatgtcggtaaagaaactaagattaaggttgtaaaaaataaggtagctccaccgtttaaggaagccgtagttgaaattatgtacggagaaggaatttctaagactggtgagcttttgaagattgcaagcgatttggatattatcaaaaaagcaggggcttggtattcttacaaagatgaaaaaattgggcaaggttctgagaatgctaagaaatacttggcagagcacccagaaatctttgatgaaattgataagcaagtccgttctaaatttggcttgattgatggagaagaagtttcagaacaagatactgaaaacaaaaaagatgagccaaagaaagaagaagcagtgaatgaagaagttccgcttgacttaggcgatgaacttgaaatcgaaattgaagaataa

SEQ ID NO: 560 - DNA, 3720 bp, Streptococcus pneumoniae
acaagaataagcagttcacttagaatagaaagggaagaaatagtggttgatgtaaatcgttttaaaagtatgcaaatcaccctagcttctccaagtaaagtccgttcatggtcttatggagaagtcaaaaaacctgaaacaatcaattatcgtaccttgaaaccagaacgtgaaggactctttgatgaagtgatctttggtcctacaaaagactgggaatgtgcttgtggtaagtacaaacgcattcgttacagaggaattgtttgtgaccgctgtggggttgaagtaacgcgtacgaaagttcgtcgtgagcgtatgggacatatcgaattgaaagctcctgtatctcacatctggtacttcaaggggattccaagccgtatgggcttgacccttgatatgagccctcgtgccctcgaggaagttatctactttgcggcttatgtggtgattgatcctaaggatacaccacttgagcacaagtctatcatgacagagcgcgaataccgagagcgcttgcgtgaatatggttatggttcatttgttgccaagatgggtgcggaagccatccaagaccttttgaagcaagtagatcttgaaaaagaaattgctgaactcaaagaagaattgaaaacagctactggacaaaagcgtgtcaaagccatccgtcgtttggatgttttggatgccttttacaagtctggaaacaaacctgaatggatgattcttaacatccttccggttatcccaccagatcttcgtccaatgttgcagttggatggtggccgttttgcctcatctgacttgaatgacctttaccgccgtgttatcaaccgtaacaaccgtttggctcgtttgcttgagttaaatgcaccaggtatcatcgttcaaaatgagaagcgtatgcttcaagaagcagttgacgctttgattgacaatggtcgtcgtggtcgtccaatcacaggaccaggtagccgtccattgaaatcattgagccacatgcttaaaggtaaacaaggacgcttccgtcaaaacttgctcggtaaacgtgttgacttctcaggacgttcagttatcgccgttggtccaactcttaagatgtaccaatgtggtgtgccgcgtgaaatggcgattgaactctttaaaccatttgtcatgcgtgaaatcgttgcccgtgatatcgtgcaaaacgtcaaagcagctaaacgcttggtggaacgcggagatgagcgtatctgggatatccttgaagaagtgattaaagaacacccagtgcttttgaaccgcgcaccgacccttcaccgtttgggtatccaagccttcgagccagtcttgattgatggtaaggctcttcgcttgcacccacttgtctgtgaagcctacaatgctgactttgacggggaccaaatggccatccacgtaccactttcagaagaagcacaagcagaagctcgtatcctcatgctagctgctgagcacatcttgaacccgaaagatgggaaaccggtagttactccatctcaggacatggttttgggtaactactacttgaccatggaagaagctggtcgcgaaggtgaaggaatggtcttcaaagaccgtgacgaagcggttatggcttaccgcaatggttatgttcacctccactcacgtgttggtatcgcaacagacagcctcaacaagccttggacagaagagcaaagacataaggtcttgcttacaacagttggtaaaattctcttcaacgatatcatgccagaggggctaccatacttgcaagaaccaaacaatgccaacttgacagaaggtgttccagctaaatacttcttgccacttggtggagatatcaaggaagctatcagcaatcttgagctcaaccctccattcaagaagaaaaaccttggaaatatcatcgctgaaatcttcaaacgtttccgtacgacagaaacttctgccctacttgaccgcatgaagaacctcggttaccaccactcaactcttgcaggattgacagtgggtattgccgatatcccagtcgttgatgacaaggctgaaatcattgaagaatcacacaaacgtgtcgaacaaatcaccaaacaattccgtcgtggtatgatcacagacgacgagcgttacaatgctgttacagctgaatggcgtgctgcccgtgaaaaacttgagaaacgcttgattgctaaccaagatcctaagaacccaatcgttatgatgatggactctggagcccgtggtaacatctcaaacttctcacagcttgccggtatgcgtggtctgatggctgctccgaatggacgtatcatggaattgccaatcctttcaaacttccgcgaaggtttgtcggtattggaaatgttcttctcaactcacggtgctcgtaaaggtatgaccgatacggcccttaagacagccgactcaggttacttgactcgtcgtttggtcgacgttgcccaagacgttatcatccgtgaggacgactgtggaactgaccgtggtctcttgatccgttctatcgcagaaggaaaagagatgatcgagtctctcgaagagcgtctcaacggtcgttacactaagaaaactgttaaacatccagaaactggtgcagtgattattggtccaaatgaattgattacagaagacaaggcgcgtgaaattgtcaatgctggtgtggaagaagtgactatccgttctgtatttacatgtaacactcgtcacggtgtctgccgtcactgttacggtatcaacttggcgactggtgatgcggttgaagttggtgaagcagttggtacaatcgctgcccaatctatcggggaacctggtacacagcttacaatgcgtaccttccacacaggtggggttgcctcaaataccgatatcactcagggtcttcctcgtgtccaagaaatctttgaagcccgcaatcctaaaggggaagcggttattacagaggttaaaggacaagttactgctatcgaagaagatgcatcaactcgtaccaagaaagtctttgttaagggtgaaactggcgaaggtgaatatgtcgttccatttacagctcgtatgcgtgtcgaagttgggggccaagtagcgcgtggtgctgctctgacagaaggttctatccaaccaaaacgtctccttgcagttcgtgatgtcttgtcagttgaaacgtaccttctcggtgaagtacaaaaagtttaccgtagccaaggggtagaaatcggtgacaaacacatcgaggtaatggttcgtcaaatgatccgtaaagtccgtgtcatggatccaggtgatacagatcttctcatgggtaccctcatggatatcaatgactttacagatgccaacaaagatgtccttatcgcaggtggagttccagcgacaggtcgcccagtccttatgggaattaccaaagcctcacttgaaacaaacagtttcttgtcagcggcttccttccaggaaacaactcgtgtccttactgacgcagctatccgtggtaagaaagaccatctccttggacttaaagaaaatgttatcatcggtaagatcatcccagctggtactggtatggcccgttaccgtaaccttgaaccacatgctgtcaacgaagaagaataccttaatcctccagtagaggaagaaggaaatgaagaaacaacagaagtagttgtggatactgccgttgaaactgtggaagaaacagtagaataa

SEQ ID NO: 561 - DNA, 1011 bp, Streptococcus pneumoniae
atttttgaggagttgtctatgaagaaaagttttatccatcaacaagaagaaatttcctttgtcaaaaacacttttacccagtatttgaaagataagctagaagttgtcgaagttcaaggtcctatcttgagtaaggtcggtgacggaatgcaggacaacctgtctggtgtggaaaatccagtatcggtcaaggttctccaaatccctgatgctacttatgaagtggtgcactcacttgctaaatggaaacgccacaccttggctcgttttggctttggtgaaggagagggtctctttgtccacatgaaagcccttcgtccagatgaggattccttggatgcaacccactctgtttatgttgaccagtgggactgggagaaggttatcccaaatggtaagcgtaacatcgtttatctaaaagaaacagttgagaagatttataaggctattcgcctgactgagctagctgttgaagcccgctatgacatcgagtctatcttgccaaaacaaattacctttatccatacagaagaattggtagaacgctacccagacttgacaccgaaagaacgtgaaaatgcgatttgtaaagaatttggagccgtctttttgattggtatcggtggcgagttgccagatggtaaaccgcacgatggacgtgcaccagactatgatgactggacaagcgagtctgagaatggctacaagggtctaaatggtgatattcttgtctggaatgagtctttaggtggagcctttgagttgtcttctatgggaattcgtgtagatgaagaaactcttagacgtcaggtggaaattacaggtgatgaagaccgcttggaattggaatggcacaagtctttgttgaatggtctattcccattgacaatcggtggaggaattggacaatctcgtatggccatgttcctacttcgcaagagacacatcggagaagtgcaaacaagtgtttggcctcaagaagtccgcgatacttacgaaaatattttgtag

SEQ ID NO: 562 - DNA, 837 bp, Streptococcus pneumoniae
gaaatagaaatgaaattaagaagaagtgatcggatggttgtcatttccaactatttgattaataatccttataaactaactagtctcaatacttttgctgaaaagtatgagtctgctaaatcatccatctcagaagatatcgtcattatcaaacgcgcctttgaggaaattgaaatcggtcatatccagacagtgactggggctggcggaggtgtcatcttcacaccgtctatttcgagtcaggatgctaaggaaatggttgaagacttgcgtaccaagttgtcagaaagtgaccgtatcttgccaggtggttatatctatctgtctgatttgcttagcacaccagccatcttgaaaaatattggtcgtattattgccaaaagctttatggaccaaaaaattgacgcggttatgaccgtagcaactaagggtgtgccacttgcaaatgcagttgccaatgtcctcaatgtctcttttgtcattgtgcgccgtgacctgaaaattaccgaaggttcaactgttagcgtcaactatgtttcaggttcaagtggtgaccgtatcgagaaaatgttcctttcaaaacgtagtcttaaggcaggcagccgtgtcttgattgtggatgacttcttgaaaggtggcggaacggtcaatggtatgattagtctcttgcgcgagttcgactcagaactggcaggtgtagcggtctttgcggacaatgcccaagaagaacgtgaaaagcagtttgactacaagtcactcttgaaggtaaccaatattgatgtcaagaaccaagccatcgatgttgaggttggcaatatctttgacgaagataaataa

SEQ ID NO: 563 - DNA, 1224 bp, Streptococcus pneumoniae
ggaaacaagatgaaagaatataacaagtctagtaagttagagcatgttgcttatgatatccgtggtcctgtattggaagaagccatgcggatgcgagcgaatggagaaaagattttacgtctgaatacaggaaatccagcagaatttggctttacagcgccagacgaggtcattcatgacttgattatgaatgcgcgtgatagtgaaggctattctgactccaaagggattttctcagcccgtaaggccatcatgcagtattgccagctgaagaaattcccaaacgtagatactgatgatatttaccttggaaatggtgtcagtgagttgattgtcatgtccatgcaggggcttttggacaatggggatgaggtcttagtgccaatgccagactatcctctatggacggcggctgtcagcctagctggaggaaatgccgttcactatatctgtgatgaagctgtggaatggtacccagatattgacgatatcaagtcaaaaatcacttccaataccaaggcaattgtccttatcaatccaaataacccaactggagccctttatcctaaggaactcttgctggagattattgagattgcccgtcaaaacgatttgattatctttgcggatgaaatctatgaccgcatggtaatggacggacatgtgcatacgcctgtggcgagcttggcaccagatgtcttctgtgtcagcatgaatggtctgtcaaaatcccaccgcatagcaggtttccgtgtgggttggatggtcttgtctggccctaagactcatgttaagggctatatcgaagggctcaatatgctgtccaatatgcgcctttgctctaacgttttggcccaacaagtcgtacaaacttccttggggggtcaccaatcagtcgatgaattgcttcttcctggtggacgaatctacgagcaaagaaatttcatctataatgccattcaagatattccaggtttgtctgccgttaaacccaaggcggggctctatatcttcccaaaaatcgaccgcaatatgtaccgtatcgatgatgatgagcagtttgtccttgatttcttgaagcaggaaaaggttctcttggttcatggtcgaggctttaactggcaggaaccagaccacttccgtatcgtttaccttcctcgtgttgatgagttagcccaaatccaagaaaagatgactcgtttcttgaaacagtatcgtagatag

SEQ ID NO: 564 - DNA, 528 bp, Streptococcus pneumoniae
aaaatactttttttgctttacttctatagtgaaaaggtttacaattatagtaagaaaatttcaggaggtttcattatggcacaacgttaccaaaatatcatggtcgcaatcgatggttctaaggaagcggacttggcttttgtcaagggagttcattctgctctacgaaacgacgctaaactcaccatcgcacatgtcattgacacacgcgctctccaaagcgtatccacctttgatgctgaagtttacgaagaactccaagtcgacgctgaaagtctgatgaaagagtacgaaaaacgtgctaaagatgctggggtagcagatgttcatatcgtcattgaaatgggaaatccaaagaccctgctagcacgtactattccagatgccgaggaagtggacctcatcctcgttggcgcaactggtctcaacgcctttgaacgcctcttggtcggctcttcatctgaatacatactccgccatgctaaggtcgatttgctggttgtgagagaacaagaaaaaaccttataa

SEQ ID NO: 565 - DNA, 1113 bp, Streptococcus pneumoniae
aaacgaaattttcacatcttcacttttgtaagtagatatagagcttcaatcagtacctctacttgtaaaagaatgtgtgagatagaaaggacaggaaaaggaatgaatgcagatgatacagtaaccatttatgatgtcgctcgtgaagcaggtgtttccatggcgacggtcagccgtgtggtcaatggcaataaaaatgtaaaagagaatacccgtaaaaaagtgctagaggtaattgatcgtttggattatcgtccaaatgcagttgcgcgtggtcttgcaagtaaaaagacaaccactgtcggtgtcgtgattccaaatattaccaatggttatttttcgagtttggctaaggggattgatgatattgcagaaatgtacaagtacaatattgtcctagctaatagcgatgaagataacgagaaagaagtttctgttgtcaataccctcttttcaaagcaggtagatggcattatctatatggggtatcacttgacagataaaattcgctcagaattttcgcgttcacgtactccgattgttctcgcaggaactgtcgatgttgagcaccagttgccaagtgtcaatattgactataagcaagcaacaattgatgcagtgagttaccttgctaaagaaaatgagcgtattgctttcgttagcggtccgctagtggatgacatcaatggtaaggttcgtttagttggctacaaggaaaccttgaaaaaagcaggaatcacttatagtgagggtttggtatttgaatctaaatatagctatgatgatggttacgccttagcagagcgtttgatttcatcaaatgcaactgcagcagttgtgacaggtgatgagttggcagcaggagtcttgaacggtttggctgataagggtgtttctgtgccagaagattttgaaattattactagtgatgattcacaaatctcacgctttacccgtccaaacttgacaacgattgcccaacctctttatgaccttggtgccattagtatgcgtatgttgaccaagattatgcataaggaagagttggaagaacgtgaagttctcttacctcatggtttgacagaacgtagctcaacacgaaaacgtaaatag

SEQ ID NO: 566 - DNA, 591 bp, Streptococcus pneumoniae
aagattagtggagttaattacactagaaatcttctatttatgaaaggaaatatcatggatagttttgataaagggtggtttgttttacaaacttattctggttatgaaaataaggtgaaagaaaatctattacaacgtgcacaaacctacaatatgttggataatattctacgcgttgaaattccaacacaaacagtgcaagttgaaaaaaatggaaagagaaaagaagtagaagaaaatcgctttccaggttatgttcttgtagaaatggtcatgacagatgaagcttggtttgttgttcgaaacacaccaaatgttacaggatttgtcggatcacacgggaacagatcaaaaccaactccattattggaacaagaaattcgcgacattttggtatctatgggacaaactgttcaagaatttgatttcgatgttgagattggtcaaactgtacgtattattgatggtgcttttgcagactacactggtaagattacagaaattgataataacaaagtgaaaatgattatctctatgtttggtaatgacacagttgcagaagtaaatctaaaccaaatcgcagaattataa

SEQ ID NO: 567 - DNA, 2205 bp, Streptococcus pneumoniae
aataaacgcatgaaattagataaattatttgagaaatttctttctctttttaaaaaagaaacaagtgaactagaggactctgattctactatcttacgtcgctctcgtagtgatcgaaaaaaattagcccaagtaggtccgattcgaaaattctggcgtcgttatcatctaacaaagattatccttatactaggtttgagtgcaggcttgctagttggaatctatttgtttgctgtagccaagtcgaccaatgtcaatgatttgcaaaatgccttgaaaactcggactcttatttttgaccgtgaagaaaaagaggctggtgccttgtctggtcaaaagggaacctatgttgagctgactgacatcagtaaaaacttgcagaatgctgttattgcgacagaagaccgttctttctataaaaatgacgggattaactatggccgttttttcttggctattgtcactgctggacgttcaggtggtggctctaccattacccaacagctggctaaaaacgcctatttatcgcaggatcaaactgttgagagaaaagcgaaagaatttttccttgccttagaattaagcaaaaaatatagtaaggagcaaattctaaccatgtaccttaacaacgcttattttggaaatggtgtgtggggtgtagaagatgcgagtaagaaatactttggagtttctgcatcagaagtgagtctggatcaagctgcgactctggcagggatgctcaaggggccggaactgtataatcccttgaattccgtagaagattctactaatcggcgcgatactgtcttgcagaatatggttgcagcaggatatattgataaaaaccaagaaaccaaagctgctgaagttgatatgacttcgcaattgcacgataagtatgaaggaaaaatctcagattaccgttacccctcttattttgatgcggtggttaatgaagctgtttccaagtataatctaacagaggaagagattgtcaataatggctaccgcatttacacagagctggaccaaaactaccaagcaaatatgcagattgtttatgaaaacacatcgctatttccgagggcagaggatggaacgtttgctcaatcaggaagtgtagccctcgaaccgaaaacagggggagttcgtggagttgtcggtcaagttgctgacaatgataaaactggattccggaatttcaactatgcaacccaatcaaagcgtagtcctggttctacaattaagcctttagttgtttatacgccagcagttgaagcaagctgggctttgaataagcagttggataaccataccatgcagtatgacagctataaggttgataactatgcagggatcaaaacgagtcgagaagttcctatgtatcaagccttggcagaatcgcttaatctacctgctgttgccactgttaatgatttgggtgtcgacaaggcttttgaggcaggcgaaaaattcggactcaacatggaaaaggtcgaccgtgttcttggtgtcgccttgggaagcggtgttgaaaccaaccctcttcaaatggctcaagcatacgccgcctttgcaaatgaaggtttaatgcctgaagctcattttattagtagaattgaaaatgctagtggacaagttattgcgagtcataaaaattcacaaaaacgggtgattgataagtctgtagctgacaagatgaccagtatgatgttggggactttcaccaacggtaccggtattagttcatcgcctgcagactatgtcatggcagggaaaactggaacaactgaagcagttttcaatccggagtacacaagtgaccagtgggtaattggttatactccggatgtagtgattagccactggcttggctttccgaccactgatgaaaaccactatctagctggctctacttcaaacggtgcagctcatgtctttagaaacattgccaataccattttaccttatacgccaggaagtacctttacggttgaaaatgcttataagcaaaatggaattgcaccagccaatacaaaaagacaagtacaaaccaatgataatagccagacagatgataatttgtctgatattcgagggcgtgcgcaaagtctagtagatgaggctagccgggctatctcagatgcgaagattaaggaaaaggctcaaacaatatgggattcgatagtcaatctatttcgctaa

SEQ ID NO: 568 - DNA, 1221 bp, Streptococcus pneumoniae
ttgaaaacgcttaaaaaggggtatcatgttatgacaaaaacaattgcaatcaatgcaggaagttcaagtttgaaatggcaattatacttaatgccagaagaaaaagtattggcgaaaggtttgattgaacgtatcggtttgaaagattcaatttcaactgtaaaatttgacggccgttctgaacaacaaattttggatattgaaaatcatatacaagccgttaaaattttattggatgacttgattcgtttcgatattatcaaggcttatgacgagattacaggtgttggacatcgtgttgttgctggtggagaatatttcaaagaatcaacagttgttgagggagatgttttagaaaaagttgaagagttgagtttgttggctcctctacacaacccggccaatgcagcaggtgttcgtgccttcaaggaattgttgccagacattaccagtgtagttgtttttgatacttccttccacacaagtatgccagagaaagcttatcgctaccctctaccaacaaaatattacacagaaaacaaggttcgtaaatacggtgctcatggtacaagtcaccagtttgtagcaggagaagctgcaaaactcttgggacgtccattagaagacttgaagttaattacctgtcatattggtaacggaggctcaattacagctgtgaaagccggcaaatctgtagacacttctatggggttcactcctcttggtggtattatgatgggaacgcgtacaggggatattgatccagctatcattccttatttaatgcaatatacagaggattttaacacaccagaagatatcagtcgtgttcttaaccgtgaatcaggtcttttgggagtttctgctaattctagcgatatgcgcgatatagaagcagctgtagcagaagggaatcacgaggctagcttggcttatgaaatgtatgttgaccgtatccaaaaacatatcggtcagtaccttgcagtgctaaatggagcagatgccattgttttcacagcaggtgtcggtgaaaatgcagagagtttccgtcgtgatgtaatctcagggatttcgtggtttggttgtgatgttgatgatgaaaagaatgtctttggcgttacaggagacatctcaacagaggcagctaaaatccgtgtcttggttattccaacagatgaagaattagtcattgcccgtgacgttgaacgcttgaaaaaataa

SEQ ID NO: 569 - DNA, 1098 bp, Streptococcus pneumoniae
actataaatattacaaataaaaaaacggaggagtgctttatgaaagcctatacttatgttaaaccaggacttgcttcttttgttgatgtagacaaaccagttattcgcaagccaacagacgctattgtgcgtattgtaaaaaccactatttgtggaacagacctccatattatcaaaggggatgttcctacttgccaaagtggtaccattcttggccacgaagggattgggattgttgaagaagttggggaaggagtttccaacttcaaaaaaggtgacaaggtcttgatttcttgcgtctgtgcctgtggtaaatgctactactgtaaaaaaggaatttatgctcactgtgaagacgaagggggctggattttcggtcacttgattgatggtatgcaggctgaatatctacgtgtccctcatgcagataatactctttaccatactccagaagacttgtcagatgaagctttggttatgctgtcagacattctgcctactggatatgaaattggtgtcttaaaagggaaagtagaacctggttgcagcgtagccattattggttcaggtccagttggattggctgctcttttaacagcccaattctattcaccagctaaattgattatggtagacctagacgataaccgcttggaaactgccctatcattcggtgcgactcataaggttaattcttcagaccctgaaaaagccattaaagaaatttatgatttgacagatggtcgtggtgtggatgtcgctatcgaagctgttggtattcctgcaacatttgatttctgtcaaaagattatcggtgtagacggaacggttgccaactgtggtgtgcatggtaaaccagttgaattcgatttagataaactttggattcgcaacatcaatgtaacaactggtttggtatctacaaatacgactccacaattgttgaaagcacttgaaagtcataagattgaaccggaaaaattggtaactcactatttcaaactcagtgaaattgaaaaagcctacgaagtcttcagtaaggcagcagaccaccatgccattaaggtcattatcgaaaacgatatctcagaagcctaa

SEQ ID NO: 570 - DNA, 1704 bp, Streptococcus pneumoniae
ggagaaagtatgctgattcagaaaataaaaacctacaagtggcaggccctggcttcgctcctgatgacaggcttgatggttgctagttcacttctgcaaccgcgttatctgcaggaagtcttaggcgccctccttactgggaaatatgaagctatttatagtatcggggcttggttgattggtgtggccgtagtcggtctagttgctggtggactcaatgttgtcctcgcagcctatattgcccaaggagtttcatccgaccttcgggaggatgccttccgtaaaattcaaaccttttcttatgctgatattgaacaatttaatgcgggaaatctagtcgttcgaatgacaaatgatatcaaccagattcagaacgttgtcatgatgaccttccaaattcttttcagacttcccctcttgttcatcggttcgtttatcctagcggttcaaaccttaccttctctgtggtgggtgattgttctcatggtagtcttgatttttggtttgactgctgtcatgatgggaatgatggggcctcgttttgccaagtttcaaacccttcttgagcgcatcaatgccattgccaaggaaaatttacgtggcgttcgtgtggtcaagtcctttgtccaagaaaaagagcaatttgctaagtttacagaggtctcagacgagcttcttggtcaaaacctttacattggttatgccttttcagtagtggaaccctttatgatgttggttggttacggggcggtcttcctctctatttggctggtcgcgggaatggttcagtcggatccgtctgttgttggttccatcgcttcttttgttaattacctaagccagattatctttaccattgttatggttggatttttgggaaattctgtcagccgtgccatgatttccatgcgtcgtattcgagaaattcttgacgcagagccagctatgaccttcaaggatatcccagatgaagagttggttggaagtcttagctttgaaaatgtgacctttacctatccaatggacaaggaaccgatgctgaaagatgtgagctttactattgaacctggtcaaatggttggtgtagttggagcgactggtgcaggaaagtcaaccttggctcaattgattccacgtctctttgatccacaggacggggccattaaaatcggtggcaaggatattcgagaagtgagtgaaggaaccctgcgtaaaacagtttccatcgttctccaacgtgccattctttttagtggaacgattgcagataacttgagacaggggaaggggaatgctactctatttgaaatggagcgcgcagccaatattgcccaggctagtgaattcattcatcgtatggagaaaacctttgaaagtccagttgaagaacggggaaccaatttctctggtggacaaaaacaaaggatgtcgattgcgcgtgggattgtcagcaatccacgtattctgatttttgatgattcgacctcagccttggatgccaaatcagagcgcttggtgcaagaagctttgaataaggacttgaaggggacgacaaccattattattgctcaaaaaattagctcggttgtccatgcagacaagatcttggttctaaatcaaggacgattgattggtcaaggtacgcatgcagacttggttgccaacaatgccgtttaccgtgaaatctatgaaacacagaaatga

SEQ ID NO: 571 - DNA, 1050 bp, Streptococcus pneumoniae
aataagagaaagaactctatcaaggaggaaatcatggaaaaacaaaccgtcgccgtcttggggcctggttcttggggaaccgccctttcacaagtcttaaatgacaatggacacgaggtacgtatttggggaaatcttcccgagcaaatcaatgaaattaatacacaccatactaataagcactactttaaagatgtcgttctagacgaaaatatcattgcctacaccgacttagcagaaacattgaaagatgtggatgcgattttgtttgttgtcccaacaaaagtgacacgacttgttgcccagcaagttgcacaaaccttggaccataaggttatcatcatgcacgcatcaaagggattagaacctgatagccataaacgattatcaaccattcttgaagaagaaattcctgaacatctccgtagtgatatcgtcgttgtttcagggcctagtcatgcagaagagaccattgtgcgtgacctaactttaataactgctgcttctaaagatttacaaacagctcaatacgttcagaagctatttagtaatcactacttccgactttataccaatacggatgttatcggggttgaaactgctggtgctcttaaaaatattattgctgtcggtgctggagctttacatggtcttggatttggtgataatgctaaggcagccatcatcgctcgaggtttagcagaaatcacccgcctaggggtagcactcggggccagtccattgacctatagcggcttatctggtgtgggagatttgatcgtaacgggaacttccatccactctcgtaactggagagctggagatgctctcggacgaggagaatccctagctgatatagaagctaatatgggcatggtaatcgaaggaatttcaacgactcgagcagcctatgaactagcccaagaacttggagtctatatgcccattacacaggctatttaccaagttatttatcacggaaccaatatcaaagatgccatttatgacatcatgaacaatgaatttaaagcagaaaatgagtggtcttaa

SEQ ID NO: 572 - DNA, 1284 bp, Streptococcus pneumoniae
gaggaatacactatgtcatctaaatttatgaagagcgctgcggtgcttggaactgctacacttgctagcttgcttttggtagcttgcggaagcaaaactgctgataagcctgctgattctggttcatctgaagtcaaagaactcactgtatatgtagacgagggatataagagctatattgaagaggttgctaaagcttatgaaaaagaagctggagtaaaagtcactcttaaaactggtgatgctctaggaggtcttgataaactttctcttgacaaccaatctggtaatgtccctgatgttatgatggctccatacgaccgtgtaggtagccttggttctgacggacaactttcagaagtgaaattgagcgatggtgctaaaacagacgacacaactaaatctcttgtaacagctgctaatggtaaagtttacggtgctcctgccgttatcgagtcacttgttatgtactacaacaaagacttggtgaaagatgctccaaaaacatttgctgacttggaaaaccttgctaaagatagcaaatacgcattcgctggtgaagatggtaaaactactgccttcctagctgactggacaaacttctactatacatatggacttcttgccggtaacggtgcttacgtctttggccaaaacggtaaagacgctaaagacatcggtcttgcaaacgacggttctatcgtaggtatcaactacgctaaatcttggtacgaaaaatggcctaaaggtatgcaagatacagaaggtgctggaaacttaatccaaactcaattccaagaaggtaaaacagctgctatcatcgacggaccttggaaagctcaagcctttaaagatgctaaagtaaactacggagttgcaactatcccaactcttccaaatggaaaagaatatgctgcattcggtggtggtaaagcttgggtcattcctcaagccgttaagaaccttgaagcttctcaaaaatttgtagacttccttgttgcaactgaacaacaaaaagtattatatgataagactaacgaaatcccagctaatactgaggctcgttcatacgctgaaggtaaaaacgatgagttgacaacagctgttatcaaacagttcaagaacactcaaccactgccaaacatctctcaaatgtctgcagtttgggatccagcgaaaaatatgctctttgatgctgtaagtggtcaaaaagatgctaaaacagctgctaacgatgctgtaacattgatcaaagaaacaatcaaacaaaaatttggtgaataa

SEQ ID NO: 573 - DNA, 1023 bp, Streptococcus pneumoniae
caggaggtcattcttatgactgaaaaactaatcaattcaaaaccaaatggtgtattcgcattgattctcattgagttgacaatcgtacttggtatctttatatttataatgggggttggttcggaaaacatttttggaattattatcggacctttactaatcgtaattgcaggtctagctcatgctggtttaaaagttgtcaaacctcaagaagctctggttctgacactctttggtaactatacaggtaccatcaaagaacctggcttttactttgtcaatcccttcagcgtagcagtcaaccctgcaaaccacactcgacttggacaaagtggtgatgttagcacaaaatctccttttttaggagctaaatcatcaaatgacaatgatgtaaatcttgaaattggcaagaaacagatttccctcaaagtcatgaccttgagcaattctcgtcaaaaaatcaatgattgcttaggaaaccctgtagaaatcggtatcgcggtaacttggagagttgtcgataccgctaaggcagtcttcaacgttgataactacaaagaatatctttcattgcaatgtgatagcgccctccgtaatattgtccgcatctatccttacgatgtgtctcctaatgtggatactacgggtgatgggcaagcagatgaaggtagtctccgtggctctagcgaaattgttgctaaccgtattcgtgaagaaatccaaagtcgtgttgaggatgctggcttggaaatccttgaagcacgtatcacttacctagcttatgctccagaaattgctgccgttatgcttcaacgccaacaagcatctgccattattgatgcacggaagatgattgtagatggtgctgtaggaatggttgaaatggcactagaacggctcaatgaaggggaattggtagaacttgacgaagaacgaaaagctgccatggtttcaaatctccttgtcgttctttgtggcaatcatgatgcacaaccaattgtcaacacaggaagcctttactaa

SEQ ID NO: 574 - DNA, 1041 bp, Streptococcus pneumoniae
aaaatagaaagaggaaataataaaatgacaaattcagtattccaaggacgcagcttcttagcagaaaaagactttacccgtgcagagttagaataccttattggtctttcagctcacttgaaagatttgaaaaaacgcaatattcaacaccactaccttgctggcaagaatatcgctctcctatttgaaaaaacatctactcgtactcgtgcagcctttacaactgcggctatcgaccttggtgctcacccagaatacctcggagcaaatgatattcagttgggtaaaaaagaatctactgaagatactgctaaagtattgggacgtatgtttgacgggattgaattccgcggattcagccaacgtatggttgaagaattggcagaattctcaggcgttccagtatggaacggtctaactgacgaatggcacccaactcaaatgctcgctgactacttgactgttcaagaaaacttcggtcgcttggaaggcttgacattggtatactgtggtgatggacgtaacaacgttgccaacagcttgctcgtaacaggtgctatccttggtgtcaatgttcacatcttctcaccaaaagaactcttcccagaaaaagaaatcgttgaattggcagaaggatttgctaaagaaagtggcgcacatgttctcatcactgaagatgctgatgaagcagttaaagatgcagacgttctttacacagacgtttgggtatcaatgggtgaagaagacaaattcgcagaacgtgtagctcttcttaaaccttaccaagtcaatatggacttagttaaaaaagcaggcaatgaaaacttgatcttcctacactgcttgccagcattccacgatactcacactgtttatggtaaagacgttgctgaaaaatttggtgtagaagaaatggaagtaacagacgaagtcttccgcagcaagtacgctcgccacttcgatcaagcagaaaaccgtatgcacactatcaaagctgttatggctgctacacttggtaacctttatattcctaaagtataa

SEQ ID NO: 575 - DNA, 924 bp, Streptococcus pneumoniae
aaaaatacttgtggaggttccattatggcaatatttttcatgatttttctgattgtttgtgtgctcctattggtgatagtcacactgagtacagtttatgtggttcgtcagcagtcggtggcgattattgaacgctttgggaaataccaaaaggttgctaatagcggtattcatattcgcttgccttttgggattgactcgattgcagcacggattcagttgcgcttgttgcaaagtgatattgtggttgagactaagaccaaggacaatgtgttcgttatgatgaatgtagcgactcagtaccgtgtcaacgagcagagcgtgacagatgcttactataaactcatacgtccagaatctcagattaaatcttatatcgaagatgctcttcgctcttctgttccaaaattaaccttggatgaattgtttgagaaaaaagatgagattgcccttgaagttcaacaccaagtagcagaagaaatgaccacttacggctacattatcgtgaaaaccttgattaccaaggtcgaaccagatgcagaagttaagcaatccatgaatgaaatcaatgcggcgcaacgtaagcgggtcgcagcacaagaattggcggaagctgacaagattaaaattgtcactgcagctgaagcagaagcagaaaaagaccgccttcatggtgtggggattgcccaacaacgtaaggcgattgtggatggattggcagagtctatcaccgaactcaaggaagccaatgttggcatgacagaagaacaaatcatgtctatcctcttgaccaaccagtatttggataccttgaatacctttgcctctaaaggaaatcaaactatctttttaccaaatactccaaatggtgtggatgatatccgaacacaaatcttgtcagcccttcgcgctgagaagaaataa

SEQ ID NO: 576 - DNA, 558 bp, Streptococcus pneumoniae
agattatcctttaccagcgccctttttcttttaaaaatgagaaaatttcggtataatagtcaaacaaggtcaaggtttaaagagagaggtgggtttgttatgagatttaaaaatacatcggatcatattgaggcctacatcaaggcgattttagatcaatctggtatcgtggagttgcaacggagtcagttggcagatacctttcaggttgttcctagtcagattaactacgtgatcaagacacgctttacggaaagtagaggctacttggttgaaagtaagcgtggtggcggaggctacattcgtataggacggattgagttttctagtcatcatgaaatgctccgggagctgctttactcgattggtgagcgagtcagtcaagaaatttatgaggatattctccagcttttggttgagcaggaattgatgaccaagcaggagatgaatttgctagaatcagtagctttggatcgcgttttaggagaagaagctccagttgttcgagcaaacatgctacgtcagatcatacaagaggtagatagaaaagggaagtaa

SEQ ID NO: 577 - DNA, 477 bp, Streptococcus pneumoniae
aatgaaggaaaaggagaaagaagaatgaaagtaatctttttagcagatgttaaaggaaaaggtaaaaaaggcgaaattaaggaagtaccaacagggtatgcgcaaaactttcttatcaaaaagaatctagccaaagaagcgactgctcaagctgtaggtgaacttcgtggtaaacaaaaatcggaagaaaaagctcacgctgagatgattgcagaaggaaaagcaattaaagcacaacttgaagcagaagaaactgttgtagaatttgttgaaaaagttggtccagatggtcgtacctttggttctattaccaataagaagattgcagaagaattgcaaaagcaatttggaattaagattgataaacgtcatattcaagtacaagctccgattcgagcggttggtttgattgatgtgccagtgaaaatctatcaagatatcacaagtgtaatcaatcttcgtgtgaaagaaggataa

SEQ ID NO: 578 - DNA, 564 bp, Streptococcus pneumoniae
aaagaaggtactcatatgattaaatatagtatccgtggtgaaaacctagaagtaacagaagcaattcgtgattatgtagtttctaaactcgaaaagatcgaaaagtacttccaaccagaacaagagttggatgcccgaattaacttaaaagtttatcgtgaaaaaacggctaaagtggaagtaacgattccgcttggatctattactctccgcgcagaagatgtatctcaagatatgtatggttcaattgaccttgtaactgataaaattgaacgtcagattcgtaaaaataaaacaaaaatcgagcgtaaaaataaaaataaggtagcaactggtcaattatttacagatgctttggtggaagattcaaatattgtccagtctaaagttgttcgttcaaaacaaattgatttaaaaccaatggatttggaagaagcaattctacaaatggatttattggggcatgatttctttatctatgtggatgttgaagatcagacaaccaatgtgatttatcgtcgtgaggatggcgaaattggtttgttagaggttaaagaatcttaa

SEQ ID NO: 579 - DNA, 1080 bp, Streptococcus pneumoniae
cccggctctcctattttcaaaaaatataggagaattaaaatggcagaaattacagctaaacttgtaaaagagttgcgtgaaaaatctggtgccggtgttatggacgctaaaaaagcgcttgtagaaacagacggtgacatcgaaaaagcgattgaattgcttcgtgaaaaaggtatggctaaggcagctaagaaagctgaccgtgttgctgcagaaggtttgactggtgtttatgttaacggtaatgttgcagcagttattgaagtaaacgctgaaactgacttcgttgcaaaaaacgctcaattcgttgaattggtaaatactacagctaaagtcattgctgaaggaaaacctgctaacaacgaagaagctcttgctttgataatgccttcaggtgaaactcttgaagctgcatacgtatctgcaacagcaactatcggagagaaaatctcattccgtcgctttgcattgattgaaaaaacagacgcacaacactttggagcataccaacataacggtggacgtatcggtgttatttcagttgttgaaggtggagacgaagcacttgctaaacaattgtcaatgcacatcgcagcgatgaaaccaacagttctttcttacaaagaattggatgagcaattcgttaaagatgagttggcacaattgaatcacgttatcgaccaagacaacgaaagccgtgcaatggttaataaaccagctcttccacacttgaagtatggatcaaaagctcaattaactgatgatgttattgctcaagctgaagctgacatcaaagctgaattggctgcagaaggcaaaccagaaaaaatctgggacaaaattattccaggtaaaatggatcgcttcatgcttgataacactaaagttgaccaagcttacacacttcttgcacaagtttacatcatggatgacagcaagacagttgaagcataccttgaatcagttaacgcttcggtagttgagtttgctcgctttgaagttggtgaaggtatcgagaaagctgcaaacgacttcgaagctgaagttgcagctacaatggcagcagccttgaataactaa

SEQ ID NO: 580 - DNA, 873 bp, Streptococcus pneumoniae
tactcattcttgatgaattgtgaagcagttgcccttgggtcgttttgcgagttgaagtcaagaagaggaaaaaaacaaaaaggagaaatactcatggcagtaatttcaatgaaacaacttcttgaggctggtgtacactttggtcaccaaactcgtcgctggaatcctaagatggctaagtacatctttactgaacgtaacggaatccacgttatcgacttgcaacaaactgtaaaatacgctgaccaagcatacgacttcatgcgtgatgcagcagctaacgatgcagttgtattgttcgttggtactaagaaacaagcagctgatgcagttgctgaagaagcagtacgttcaggtcaatacttcatcaaccaccgttggttgggtggaactcttacaaactggggaacaatccaaaaacgtatcgctcgtttgaaagaaattaaacgtatggaagaagatggaactttcgaagttcttcctaagaaagaagttgcacttcttaacaaacaacgtgcgcgtcttgaaaaattcttgggcggtatcgaagatatgcctcgtatcccagatgtgatgtacgtagttgacccacataaagagcaaatcgctgttaaagaagctaaaaaattgggaatcccagttgtagcgatggttgacaccaatactgatccagatgatatcgatgtaatcatcccagctaacgatgacgctatccgtgctgttaaattgatcacagctaaattggctgacgctattatcgaaggacgtcaaggtgaggatgcagtagcagttgaagcagaatttgcagctttagaaactcaagcagattcaattgaagaaatcgttgaagttgtagaaggcgacaacgcttaa

SEQ ID NO: 581 - DNA, 834 bp, Streptococcus pneumoniae
tataaaggtagggatatgaaccgttttaaaaaatcaaaatatgtcattattgtttttgtcactgttctgcttgtgtcagctctcttagcgacgacttattcaagtacaattgtgacaaaattaggagatggaatctcattggttgatagagttgtacaaaaaccttttcagtggtttgattctgtcaaatcagatttggctcatttgacacgaacatataatgaaaatgaaagtttgaagaaacagctttaccaattagaagttaaatcaaatgaggtggaaagtttaaagacagaaaatgaacaactgcgccaattgcttgatatgaagtctaaattgcaagccacaaagactttagcagcagatgttattatgcgttctccggtatcttggaagcaggagttgaccttagatgcaggtagatcaaaaggtgcttctgagaacatgttagctattgcaaatggtggcttgattgggagtgtttcaaaagtagaggagaactctactatagtcaaccttctgacaaatacggaaaatgctgataagatttctgttaaaattcaacatggctctactacaatttatggaattattattggctatgacaaggaaaatgacgttcttaaaattagccaattaaatagtaatagcgatattagtgcgggagataaggtgactactggtggattaggaaactttaacgttgctgatattcctgttggtgaagtggttgccacaacgcatagtacagactatttgacacgagaagtaactgttaaattgagtgcagatactcataatgtagatgtgatagaattagtggggaattcataa

SEQ ID NO: 582 - DNA, 846 bp, Streptococcus pneumoniae
agggacatttggttcgaaatgaaatcaataattgatgtaaaaaatctttcttttcgctataaagaaaatcagaactactacgatgtgaaggatattacgtttcacgtgaaacgtggagaatggctttcgattgtagggcataatggtagtggtaaatcaacgacggttcgattaattgatggcttactggaagcagaatccggagagattgtaattgatggccaacgtttgactgaggaaaatgtttggaatatacgtcgtcaaatcggtatggtttttcaaaatccagacaatcaatttgttggagcgactgttgaagatgatgttgcttttggtttggaaaatcagggactttctcgtcaagaaatgaaaaagagagtggaagaagctctggctttagttggcatgttggactttaaaaagagagagccagcgcgtctatcaggtggccaaaagcaacgtgtggccattgcaggtgttgtagccctaagaccagctattttaatcttagatgaagcaacgagtatgttggatcctgaggggcgtagagaacttattgggacagtaaaaggaattcgaaaagactatgatatgacggtcatttctattacccatgatttggaagaagtcgccatgagtgatcgcgtattggtcatgaaaaaaggggaaattgaatcaactagtagtccaagggagcttttctctcgaaatgatttagatcaaattggattagacgatccttttgctaatcaattaaaaaaatctttgagccagaatggctatgatttacctgaaaattatttgacagaaagtgagctagaggataagctatgggaattgctctag

SEQ ID NO: 583 - DNA, 840 bp, Streptococcus pneumoniae
aaagaagggatgacaagtatgagaaaaaaaacaattggagaggttttacgattagctagaatcaatcagggattgagtttagatgaattgcagaaaaagacagaaatccagttagatatgttggaagcaatggaagcagacgatttcgatcaacttccaagtcctttttacacgcgttctttcttgaaaaaatatgcatgggctgttgagttagatgaccaaattgttttggatgcttatgattctgggagtatgattacttatgaggaagtagatgttgatgaagatgagttgacaggtcgtagacgttcaagtaagaaaaagaagaaaaaaacatcatttttacctttattttattttatcctttttgctttatcgattttaatttttgtgacttattatgtttggaactatattcaaactcaaccagaggagccttctctttctaattacagtgtggttcaatcaacaagttcaactagctctgttccccactcctcaagtagtagttcttctagtatagaatcagctataagtgtatcaggcgaaggaaatcatgtagaaatcgcttataagacaagtaaggaaacagttaaattgcaattggcagtttcagatgttacaagttgggtcagtgtttcagaaagcgaacttgagggcggtgtaaccttatcgccaaagaagaaaagtgcagaagcaacagttgcaactaaaagtcctgtaacaattacgttaggtgttgtaaaaggtgttgatttgacagtagataatcagactgttgatttatcgaaattaacagctcagactggacaaatcactgtaacctttactaaaaattaa

SEQ ID NO: 584 - DNA, 1020 bp, Streptococcus pneumoniae
atggaaaatcttgtgaaaagcacaagttatacatatataccggaggaaatcatgtctttttctgatttaaagctgtttgccctttcttctaataaagaattggcagaacgtgtggcgcaggagattgggatagagttggggaaatcaagtgttcgccaattttcagatggagagattcaggtcaacattgaagaatcaatccgtgggaaacacgtctttatcttacaatcaactagttcgcctgtaaatgacaatctgcttgaaattttgattatggtagatgctttgaagcgtgcgagtgcagaatctgtcaatgttgtcatgccttactatgggtatgcacgtcaggatagaaaggcgagagcgcgtgagccaatcacttcaaaacttgtcgcaaatatgcttgaagtagctggagtggatcgtttattgaccatcgacttgcatgctgcgcaaattcaaggattctttgatattcctgtggatcatttgatgggtgctcctctgattgcagattattttgagcgtcgtggtatggttggttctgactatgtggttgtcagcccggaccatggaggggtgactcgtgctcgtaagttggcagaatttttgaaaacatctatcgctattattgataaacgtcgtagcgttgataagatgaatactagtgaagttatgaatatcatcggtaaggttgaaggcaagacttgtatcttgattgatgatatgattgataccgctggaacgatttgtcatgcggcagatgctcttgcggaagctggtgctgttgaagtctatgcaagctgtacgcacccagttctttctggtcctgctacggacaatatccaaaaatcagctattaagaaattggttgttttggataccatctatctgccagaagagcgtttgattgataagattgagcagatttcaatcgctcatctcctaggggatgctatcgtacgtattcatgaaaaacgaccactttctccacttttcgatattgagaaaaaaatttaa

SEQ ID NO: 585 - DNA, 672 bp, Streptococcus pneumoniae
gaggtatctatggacttaactaagcgctttaataaacagttagataaaattcaagtttcgttgattcgtcagtttgaccaggctatttcggagattcctggggtcttgcgtttgaccttgggggaacctgattttacaacgccagaccatgtcaaggaggcgggcaagcgagcgattgatcagaaccaatcctactatacagggatgagtggtctgctgactctacgtcaggcagccagtgactttgttaaggaaaagtaccaactggactatgctcctgaaaatgaaatcttggttacaattggggcgacagaggctttatctgcgactttgacggctattttggaagagggagacaaggtacttttgccagctcctgcttatccaggctatgaaccgattgttaacttagttggggcagaaattgttgagattgatacgactgaaaatggttttgtcttgactcctgagatgttggagaaggccattttggagcagggtgataagctcaaggcggttattctcaactatccagccaatccgacaggaattacctacagtcgagagcagttagaggccttggcagctgttttacgcaagtacgaaatttttgttgtctgtgatgaggtttactcagaattgacctacacaggcgaagccatgtgtctctag

SEQ ID NO: 586 - DNA, 1302 bp, Streptococcus pneumoniae
cacatgatcaaccgttactctcgccctgagatggcgaatatttggagtgaagaaaataaataccgtgcttggcttgaggtggaaatcctctctgacgaggcatgggctgagttgggggaaatccctaaggaagatgtggctttgattcgcaagaaggcggactttgacatcgaccgtattttggaaattgagcaggagacgcgccacgatgtggtggctttcacgcgtgcggtttctgagactcttggtgaagagcgcaagtgggttcactatgggttaacttctactgacgtggtggatactgcttatggttacctctacaagcaggccaacgacatcatccgtcgtgaccttgaaaacttcactaatatcatcgctgacaaggccaaggagcacaagttcaccatcatgatggggcgtactcatggtgtgcacgctgagccgacaacctttggtcttaaattagcaacttggtacagcgaaatgaaacgcaatatcgagcgcttcgagcatgcggctgctggtgtagaagctggtaagatttctggtgcggttgggaactttgccaatatcccaccatttgtagaggagtatgtctgcgataaacttggcatccgtgcccaagaaatctctacacaagtccttcctcgtgaccttcacgctgagtactttgcggttcttgccagcattgcgacttcaatcgaacgtatggcgactgagattcgtggtctacaaaaatctgagcaacgcgaagtagaagagttctttgctaaagggcaaaaagggtcttcagcaatgcctcacaaacgcaacccaatcggttctgaaaatatgactggtctggcgcgtgtcattcgtggtcacatgattacggcttatgaaaacgtcgctctctggcatgaacgcgatatttctcactcatcagctgagcgtatcatcacaccagatacgaccattttgattgactacatgctcaaccgttttggaaatatcgtcaagaacttgacagtcttcccagaaaatatgatccgaaacatgaactcgacttttggtcttatctttagccaacgggctatgttgacattgattgaaaaaggcatgacccgtgagcaagcctatgacttggtgcaaccaaaaacagcctactcttgggacaaccaagtagactttaaaccacttcttgaggcagattcagaagtaacatcacgtctcacacaagaagaaatcgatgaaatcttcaacccagtttattacaccaaacgagtggatgatatctttgaacgtcttggactaggtgattaa

SEQ ID NO: 587 - DNA, 918 bp, Streptococcus pneumoniae
gaggtcattgttatgatacaatggtggcaaattttacttctcactttgtactcagcttatcaaatctgtgatgagttgacgatcgtttcatctgcaggttcccctgtatttgctggtttcattactggtttaatcatgggagatgtgactactggtttacttatcggtggtaacttgcaactgttcgttcttggggttggtaccttcggtggtgcttctcgtatcgacgcaacttctggtgcggttcttgcgacagccttctctgtttcacaaggaattgatgcaccgcttgccattactacaatcgctgtaccagtagcagctctcttgacttacttcgacgttcttggtcgtatgactactaccttcttcgctcaccgtgtggatgctgcaatcgaacgctttgactataaaggtattgaacgcaactacttgcttggtgcgattccgtgggctctatctcgtgcccttccagtcttctttgcccttgcttttggtggtgcctttgtacaatcagtagtagacttcgttgaagcctacaaatgggttgcagatggcttgacacttgcaggacgtatgcttccaggtcttggatttgcaatcttgcttcgttaccttccagttaaacgtaaccttcactaccttgctatgggatttggtttgacagctatgttgactgttctttactcatatgtaacaggtcttggtggcgctgttgctggtatcgtaggtactcttcctgctgaagttgctgaaaaaattggtttcgtgaacaacttcaaaggtttgtctatgattggtatttctatcgtaggtattttccttgcagtgcttcacttcaaaaatagccaaaaagtagctgtagcagcaccttctacaccatcagaaagtggggaaatcgaagatgacgaattctaa

SEQ ID NO: 588 - DNA, 855 bp, Streptococcus pneumoniae
cagcaccttctacaccatcagaaagtggggaaatcgaagatgacgaattctaattacaaacttacaaaagaagattttaatcaaatcaacaaacgtagcttgtttactttccaattaggttggaactacgaacgtatgcaagcttctggttacctttacatgatcttgcctcagttgcgtaaaatgtatggtgatggaactcctgaattgaaagaaatgatgaaagttcatactcaattcttcaatacttcaccattcttccataccattatcgctggttttgaccttgccatggaagaaaaagatggtgtaggttcaaaagacgccgttaacggtatcaagacaggtttgatgggaccattcgctcctcttggggatacaatctttggttcacttgtacctgctatcatggggtcagtcgcagcaactatggctatcgctggccaaccttgggggatcttcctttggattgcagttgcagtagcgtatgacatcttccgttggaaacagttggaatttgcttacaaagaaggggttaaccttatcaacaacatgcaaagtaccttgacagctttgattgacgctgcatctgtacttggtgtcttcatgatgggtgctcttgtagcaacagtgattaactttgaaatttcttacaagttgccaatcggtgaaaagatgattgatttccaagacatcttgaaccaaatcttcccacgtttgcttccagcaatctttactgcctttatcttctggttgcttggtaagaaaggtatgaactctactaaagctatcggtattattatcgtacttgctttggctctttctgcccttggtcactttgcacttggaatgtaa

SEQ ID NO: 589 - DNA, 1182 bp, Streptococcus pneumoniae
aaaaagaggaactcaatgctacattatacaaaagaagacttgctcgaattgggtgcagaaatcactacgcgtgaaatctaccaacagcctgatgtatggagagaagcttttgaattttatcaagcaaaacgtgaagaaattgcagccttcctacaagaaatcgctgataaacatgactatattaaggttatcttgacaggtgctgggacttctgcttatgtgggagataccttgctaccttattttaaggaagtctatgacgaacgcaaatggaatttcaatgctattgcgacaacagatatcgttgccaatccagcaacctatttgaaaaaagatgtggcaactgtccttgtgtcttttgctcgtagtgggaattcgcctgaaagtttggcgactgttgatttggccaaatccttggtggatgagctttatcaagtgacgattacttgtgcagcagatggtaaattggctcttcaagctcacggtgatgatcgtaatctcttgctcttgcaaccagctgtctctaatgatgctggatttgccatgacttctagctttacgtctatgatgttgacaactctcttggtctttgatcctacagaatttgctgttaagtctgaacgttttgaagttgtatctagtcttgcccgtaaagttttagacaaggcagaagatgtcaaagagctcgttgatttagactttaaccgtgtcatctatctaggcgctggtcctttctttggacttgctcatgaagctcagctcaagattttggaattaactgctggtcaagttgcgaccatgtatgaaagcccagttggcttccgtcacggtccaaaatctcttatcaacgacaatacagttgttttggtctttggtacaacgacagactacactcgtaagtacgacttggacttggttcgtgaagttgctggtgaccagattgctcgtcgtgttgtgcttttgagtgatcaagcttttggtcttgaaaatgtcaaagaagtggcccttggttgtggcggtgtcttgaatgatatttaccgtgtcttcccttacatcgtttatgcccaactctttgctttattgacttcactcaaggtagaaaataaaccagatacaccgtctcctacaggtacagtaaaccgtgtagtacaaggtgtcataattcacgaatatcaaaagtaa

SEQ ID NO: 590 - DNA, 654 bp, Streptococcus pneumoniae
ctatttccaccgaaatattatttatatcaggaggacattcatatgtcacgttatacaggaccatcttggaaacaagctcgtcgtcttggcctttcacttacaggtacaggtaaagaattggcacgtcgtaactacgtaccaggacaacacggaccaaacaaccgttctaaattgtcagaatacggtttgcaattggctgaaaaacaaaaacttcgtttcacttacggtgtaggtgaaaaacaattccgtaacttgttcgtacaagctacaaaaatcaaaggcggaatcctaggtttcaactttatgcttcttttggaacgtcgtttggataacgttgtttaccgtcttggtctcgcgactactcgtcgtcaagctcgtcaattcgtaaaccacggtcacatccttgttgacgggaaacgcgttgatatcccatcataccgcgtaactccaggtcaagtgatctcagttcgtgaaaaatcattgaaagttccagcaatccttgaagcagtagaagctactcttggacgtccagcattcgtatcattcgacgctgaaaaattggaaggttcattgactcgcttgccagaacgcgacgaaatcaacccagaaatcaacgaagcacttgtcgttgaattctacaacaaaatgttgtaa

SEQ ID NO: 591 - DNA, 1032 bp, Streptococcus pneumoniae
ataaaaaatttagaaaatttaagaatagaaaagagaacaaatcttatggcaaaagatattcgtgtcttactttactacctttatactccaattgaaaatgcagagcaatttgctgcagaccacttggctttctgtaaatcaatcggccttaaaggccgtatcctagtcgctgacgagggaattaacggaacagtttcaggtgactatgaaacaactcaaaaatacatggactacgttcacagccttccaggaatggaagaactctggttcaagattgacgaagaaaatgaacaagccttcaagaagatgtttgttcgctacaagaaagaaattgtccaccttggtttggaagacaacgactttgacaatgacatcaacccacttgaaacaacaggtgcttacttgtctccaaaagagttcaaagaagcgcttcttgataaagataccgttgtccttgacacacgtaacgattatgagtacgacctaggacatttccgtggagctattcgcccagatattcgcaacttccgtgagttaccacaatgggtccgtgataacaaggaaaaattcatggacaagcgtgtcgtggtttactgtacaggtggcgttcgctgtgagaaattctcaggctggatggtccgtgaaggctacaaagatgtcggccaattgcacggaggaatcgcaacttacggtaaagacccagaagttcaaggtgagctttgggatgggaaaatgtacgtctttgacgagcgtattgccgttgatgtcaaccatgtcaacccaactatcgtagggaaagactggtttgatggaacaccatgtgaacgttatgtcaactgtggaaatccattctgtaaccgtcgtatcttgacatcagaagaaaatgaagacaagtaccttcgtggatgctcacacgagtgccgtgttcacccacgtaaccgctatgtttcaaaaaatgaattgacacaagctgaagttatcgagcgcctagccgctatcggtgaaagcttggatcaagcagctactgtataa

SEQ ID NO: 592 - protein, 216 aa, Streptococcus pneumoniae
MNIAVIGLGHVGLAYALLFASKYKVVAYDIDSVKINNLKKGILPSKNEELMKFFCENNLNITFFDTFSEIKNNIDYYIIALPTDYDEKIGSFNTYEIEQTVSKILRVKPNGKIILKSTVPIGFSNKLKRLFDTKNIIFVPEFLREGCSIYDNLYPSRIVVGDETVEGRKIAELFLSISTHSTANIKNVMLVSPTEAEAIKLFSNTFLALRVAFLMN

SEQ ID NO: 593 - protein, 234 aa, Streptococcus pneumoniae
MVLRGVPMSQIDLQKLTKKNQEFVHIATQQFIKDGKTDAEIQTIFEEVIPQILEEQSKGTTARSLYGAPTHWAHSFTVKEQYEKEHPKENDDPKLMIMDSALFITSLFALVSALTTFFAADQAFGYGLITLLLVGLVGGFAFYLMYYFVYQYYGPDMDRSQRPPFWKSVLVILASMFLWLLVFFATSFLPASLNPVLDPLPLAIIGAALLALRFYLKKRLNIRSASAGPTRYQE

SEQ ID NO: 594 - protein, 314 aa, Streptococcus pneumoniae
MKQVFLSTTTEFKEIDTLEPGTWINLVNPTQNESLEIANTFDIDIADLRAPLDAEEMSRITIEDEYTLIIVDVPVTEERNNRTYYVTIPLGIIITEETIITTCLEPLPVLDVFINRRLRNFYTFMRSRFIFQILYRNAELYLTALRSIDRKSEQIESQLHQSTRNEELIELMELEKTIVYFKASLKTNERVIKKLTSSTSNIKKYLEDEDLLEDTLIETQQAIEMADIYGNVLHSMTETFASIISNNQNNIMKTLALVTIVMSIPTMVFSAYGMNFKDNEIPLNGEPNAFWLIVFIAFAMSVSLTLYLIHKKWF

SEQ ID NO: 595 - protein, 102 aa, Streptococcus pneumoniae
MANKKIRIRLKAYEHRTLDTAAAKIVESATRTGAQVAGPIPLPTERSLYTIIRATHKYKDSREQFEMRTHKRLIDIVNPTQKTVDALMKLDLPSGVNVEIKL

SEQ ID NO: 596 - protein, 208 aa, Streptococcus pneumoniae
MTKGILGKKVGMTQIFTEAGELIPVTVIEATPNVVLQVKTVETDGYNAIQVGFDDKREVLSNKPAKGHVAKANTAPKRFIREFKNVEGLEVGAEITVETFAAGDVVDVTGTSKGKGFQGVIKRHGQSRGPMAHGSRYHRRPGSMGPVAPNRVFKGKNLAGRMGGDRVTIQNLEVVQVVPEKNVILIKGNVPGAKKSLITIKSAVKAGK

SEQ ID NO: 597 - protein, 207 aa, Streptococcus pneumoniae
MANVTLFDQTGKEAGQVVLSDAVFGIEPNESVVFDVIISQRASLRQGTHAVKNRSAVSGGGRKPWRQKGTGRARQGSIRSPQWRGGGVVFGPTPRSYGYKLPQKVRRLALKSVYSEKVAENKFVAVDALSFTAPKTAEFAKVLAALSIDSKVLVILEEGNEFAALSARNLPNVKVATATTASVLDIANSDKLLVTQAAISKIEEVLA

SEQ ID NO: 598 - protein, 98 aa, Streptococcus pneumoniae
MNLYDVIKKPVITESSMAQLEAGKYVFEVDTRAHKLLIKQAVEAAFEGVKVANVNTINVKPKAKRVGRYTGFTNKTKKAIITLTADSKAIELFAAEAE

SEQ ID NO: 599 - protein, 277 aa, Streptococcus pneumoniae
MGIRVYKPTTNGRRNMTSLDFAEITTSTPEKSLLVALKSKAGRNNNGRITVRHQGGGHKRFYRLVDFKRNKDNVEAVVKTIEYDPNRSANIALVHYTDGVKAYIIAPKGLEVGQRIVSGPEADIKVGNALPLANIPVGTLIHNIELKPGRGGELVRAAGASAQVLGSEGKYVLVRLQSGEVRMILGTCRATVGVVGNEQHGLVNLGKAGRSRWKGIRPTVRGSVMNPNDHPHGGGEGKAPVGRKAPSTPWGKPALGLKTRNKKAKSDKLIVRRRNEK

SEQ ID NO: 600 - protein, 93 aa, Streptococcus pneumoniae
MGRSLKKGPFVDEHLMKKVEAQANDEKKKVIKTWSRRSTIFPSFIGYTIAVYDGRKHVPVYIQEDMVGHKLGEFAPTRTYKGHAADDKKTRRK

SEQ ID NO: 601 - protein, 114 aa, Streptococcus pneumoniae
MAEITSAKAMARTVRVSPRKSRLVLDNIRGKSVADAIAILTFTPNKAAEIILKVLNSAVANAENNFGLDKANLVVSEAFANEGPTMKRFRPRAKGSASPINKRTAHITVAVAEK

SEQ ID NO: 602 - protein, 217 aa, Streptococcus pneumoniae
MGQKVHPIGMRVGIIRDWDAKWYAEKEYADYLHEDLAIRKFVQKELADAAVSTIEIERAVNKVNVSLHTAKPGMVIGKGGANVDALRAKLNKLTGKQVHINIIEIKQPDLDAHLVGEGIARQLEQRVAFRRAQKQAIQRAMRAGAKGIKTQVSGRLNGADIARAEGYSEGTVPLHTLRADIDYAWEEADTTYGKLGVKVWIYRGEVLPARKNTKGGK

SEQ ID NO: 603 - protein, 122 aa, Streptococcus pneumoniae
MIQTETRLKVADNSGAREILTIKVLGGSGRKFANIGDVIVASVKQATPGGAVKKGDVVKAVIVRTKSGARRADGSYIKFDENAAVIIREDKTPRGTRIFGPVARELREGGFMKIVSLAPEVL

SEQ ID NO: 604 - protein, 101 aa, Streptococcus pneumoniae
MFVKKGDKVRVIAGKDKGTEAVVLTALPKVNKVIVEGVNIVKKHQRPTNELPQGGIIEKEAAIHVSNVQVLDKNGVAGRVGYKFVDGKKVRYNKKSGEVLD

SEQ ID NO: 605 - protein, 180 aa, Streptococcus pneumoniae
MANRLKEKYLNEVVPALTEQFNYSSVMAVPKVDKIVLNMGVGEAVSNAKSLEKAAEELALISGQKPLITKAKKSIAGFRLREGVAIGAKVTLRGERMYEFLDKLVSVSLPRVRDFHGVPTKSFDGRGNYTLGVKEQLIFPEINFDDVDKTRGLDIVIVTTANTDEESRALLTGLGMPFAK

SEQ ID NO: 606 - protein, 132 aa, Streptococcus pneumoniae
MVMTDPIADFLTRIRNANQAKHEVLEVPASNIKKGIAEILKREGFVKNVEIIEDDKQGVIRVFLKYGPNGEKVITNLKRVSKPGLRVYKKREDLPKVLNGLGIAILSTSEGLLTDKEARQKNVGGEVIAYVW

SEQ ID NO: 607 - protein, 178 aa, Streptococcus pneumoniae
MSRIGNKVIVLPAGVELANNDNVVTVKGSKGELTREFSKDIEIRVEGTEITLHRPNDSKEMKTIHGTTRALLNNMVVGVSEGFKKELEMRGVGYRAQLQGSKLVLAVGKSHPDEVEAPEGITFELPNPTTIVVSGISKEVVGQTAAYVRSLRSPEPYKGKGIRYVGEFVRRKEGKTGK

SEQ ID NO: 608 - protein, 118 aa, Streptococcus pneumoniae
MISKPDKNKLRQKRHRRVRGKLSGTADRPRLNVFRSNTGIYAQVIDDVAGVTLASASTLDKEVSKGTKTEQAVAVGKLVAERANAKGISEVVFDRGGYLYHGRVKALADAARENGLKF

SEQ ID NO: 609 - protein, 164 aa, Streptococcus pneumoniae
MAFKDNAVELEERVVAVNRVTKVVKGGRRLRFAALVVVGDHNGRVGFGTGKAQEVPEAIRKAVDDAKKNLIEVPMVGTTIPHEVLSEFGGAKVLLKPAVEGSGVAAGGAVRAVVELAGVADITSKSLGSNTPINIVRATVEGLKQLKRAEEIAALRGISVSDLA

SEQ ID NO: 610 - protein, 146 aa, Streptococcus pneumoniae
MKLHELKPAEGSRKVRNRVGRGTSSGNGKTSGRGQKGQKARSGGGVRLGFEGGQTPLFRRLPKRGFTNINAKEYAIVNLDQLNVFEDGAEVTPVVLIEAGIVKAEKSGIKILGNGELTKKLTVKAAKFSKSAEEAITAKGGSVEVI

SEQ ID NO: 611 - protein, 436 aa, Streptococcus pneumoniae
MFFKLLREALKVKQVRSKILFTIFIVLVFRIGTSITVPGVNANSLNALSGLSFLNMLSLVSGNALKNFSIFALGVSPYITASIVVQLLQMDILPKFVEWGKQGEVGRRKLNQATRYIALVLAFVQSIGITAGFNTLAGAQLIKTALTPQVFLTIGIILTAGSMIVTWLGEQITDKGYGNGVSMIIFAGIVSSIPEMIQGIYVDYFVNVPSSRITSSIIFVIILIITVLLIIYFTTYVQQAEYKIPIQYTKVAQGAPSSSYLPLKVNPAGVIPVIFASSITAAPAAILQFLSATGHDWAWVRVAQEMLATTSPTGIAMYALLIILFTFFYTFVQINPEKAAESLQKSGAYIHGVRPGKGTEEYMSKLLRRLATVGSLFLGVISILPIAAKDVFGLSDVVAFGGTSLLIIISTGIEGIKQLEGYLLKRKYVGFMDRTE

SEQ ID NO: 612 - protein, 212 aa, Streptococcus pneumoniae
MNLLIMGLPGAGKGTQAAKIVEQFHVAHISTGDMFRAAMANQTEMGVLAKSYIDKGELVPDEVTNGIVKERLSQDDIKETGFLLDGYPRTIEQAHALDKTLAELGIELEGVINIEVNPDSLLERLSGRIIHRVTGETFHKVFNPPVDYKEEDYYQREDDKPETVKRRLDVNIAQGEPIIAHYRAKGLVHDIEGNQDINDVFSDIEKVLTNLK

SEQ ID NO: 613 - protein, 121 aa, Streptococcus pneumoniae
MARIAGVDIPNDKRVVISLTYVYGIGLATSKKILAAAGISEDVRVRDLTSDQEDAIRREVDAIKVEGDLRREVNLNIKRLMEIGSYRGIRHRRGLPVRGQNTKNNARTRKGKAVAIAGKKK

SEQ ID NO: 614 - protein, 127 aa, Streptococcus pneumoniae
MAKPTRKRRVKKNIESGIAHIHATFNNTIVMITDVHGNAIAWSSAGALGFKGSRKSTPFAAQMASEAAAKSAQEHGLKSVEVTVKGPGSGRESAIRALAAAGLEVTAIRDVTPVPHNGARPPKRRRV

SEQ ID NO: 615 - protein, 128 aa, Streptococcus pneumoniae
MAYRKLGRTSSQRKAMLRDLTTDLLINESIVTTEARAKEIRKTVEKMITLGKRGDLHARRQAAAFVRNEIASENYDEATDKYTSTTALQKLFSEIAPRYAERNGGYTRILKTESRRGDAAPMAIIELV

SEQ ID NO: 616 - protein, 137 aa, Streptococcus pneumoniae
MPTINQLVRKPRKSKVEKSKSPALNVGYNSHKKVQTNVSSPQKRGVATRVGTMTPKKPNSALRKFARVRLSNLIEVTAYIPGIGHNLQEHSVVLLRGGRVKDLPGVRYHIVRGALDTAGVNDRKQGRSKYGTKRPKA

SEQ ID NO: 617 - protein, 156 aa, Streptococcus pneumoniae
MSRKNRAPKRDVLPDPLYNSQLVTRLINRVMLDGKRGTAASIVYGAFEQIKEATGNDALEVFETAMENIMPVLEVRARRVGGSNYQVPVKVRPERRTTLGLRWLVTIARLRGEHTMQDRLAKEILDAANNTGAAVKKREDTHRMAEANRAFAHFRW

SEQ ID NO: 618 - protein, 303 aa, Streptococcus pneumoniae
MTEKLQLTKSDRKKVWWRSTFLQGSWNFERMQNLGWAYTLIPAIKKLYTKKEDQIAALERHLEFFNTHPYVAAPVMGVTLALEEERANGVEIDDAAIQGVKIGMMGPLAGIGDPVFWFTVRPILGSLGASLALTGNILGPLLFFVAWNLIRMSFLWYVQEIGYKAGSEITKDMSGGILQDITKGASILGMFILAVLVQRWVNIKFAFDVSKVQLDEKAYIHWDKLPEGSKGIQEAFAQVGQGLSQTPEKVTTFQQNLDMLIPGLSGLLLTLLCMYLLKKKVSPITIILALFAVGIVAHVLHIM

SEQ ID NO: 619 - protein, 267 aa, Streptococcus pneumoniae
MSIISMVLVVVVAFFAGLEGILDQFQFHQPLVACTLIGLVTGHLEAGIILGGSLQMIALGWSNIGAAIAPDAALASVAAAIIMVLGGDFTKTGIGVAQAVAIPLAVAGLFLTMIVRTISVGLVHTADAAAKKGDFGAVERAHFIALLFQGLRIALPAALLLMVPTETVQSILSAMPDWLKDGMAIGGGMVVAVGYAMVINMMATREVWPFFALGFVLAAVSDITLIGFGAIGVAIALIYLHLSKTGGNGGGGAATSNDPIGDILEDY

SEQ ID NO: 620 - protein, 332 aa, Streptococcus pneumoniae
MTIMSIGIIIASHGEFAAGIHQSGSMIFGEQEKVQVVTFMPNEGPDDLYAKFNNAVAAFDAEDEVLVLADLWSGSPFNQASRVMGENPERKFAIITGLNLPMLIQAYTERLMDAAAGVEKVAANIIKEAKDGIKALPEELNPVEEVASAAAAPVAQTAIPEGTVIGDGKLKINLARLDTRLLHGQVATAWTPDSKANRIIVASDNVAKDDLRKELIKQAAPGNVKANVVPIQKLIEISKDPRFGETHALILFETPQDALRAIEGGVPIKTLNVGSMAHSTGKTLVNTVLSMDKEDVATFEKMRDLGVEFDVRKVPNDSKKDLFDLINKANVK

SEQ ID NO: 621 - protein, 339 aa, Streptococcus pneumoniae
MKAVVVNPESTGVAIEEKVLRPLETGEALVEVEYCGVCHTDLHVAHGDFGQVPGRVLGHEGIGIVKEIAPDVKSLKVGDRVSVAWFFEGCGTCEYCTTGRETLCRTVKNAGYSVDGGMAEQCIVTADYAVKVPDGLDPAQASSITCAGVTTYKAIKEAKVEPGQWVVLYGAGGLGNLAVQYAKKVFNAHVIAVDINNDKLALAKEVGADIVINGLEVEDVAGLIKEKTDGGAHSAVVTAVSKVAFNQAVDSIRAGGRVVAVGLPSEMMELSIVKTVLDGIQVIGSLVGTRKDLEEAFQFGAEGLVVPVVQKRPVEDAVAIFDEMEKGQIQGRMVLDFTH

SEQ ID NO: 622 - protein, 148 aa, Streptococcus pneumoniae
MNKTTFMAKPGQVERKWYVVDATDVPLGRLSAVVASVLRGKNKPTFTPHTDTGDFVIVINAEKVKLTGKKATDKIYYTHSNHPGGLKQISAGELRSKNAVRLIEKSVKGMLPHNTLGRAQGMKLKVFVGAEHTHAAQQPEVLDISGLI

SEQ ID NO: 623 - protein, 130 aa, Streptococcus pneumoniae
MSQAQYAGTGRRKNAVARVRLVPGTGKITVNKKDVEEYIPHADLRLVINQPFAVTSTVGSYDVFVNVIGGGYAGQSGAIRHGIARALLQVDPDFRDSLKRAGLLTRDSRKVERKKPGLKKARKASQFSKR

SEQ ID NO: 624 - protein, 272 aa, Streptococcus pneumoniae
MTGSNKLTKRDYLKTSLRAFFCQNGFNYSNYQGLGYANVMYPALKKHYGEDQEGFYQALEENCEFYNTNPHFLPFITSLHLVMLENGRPAKETRSIKMALMGPLAGIGDSLSQFCLAPLFSTIAASFAQEGLVVGPILFFLAMNTILTAIKLSTGLYGYKLGTTVIDKLSEQMATISRIANIIGVTVIAGLAATSVKIMVPITFAAGEVKADAKQSIVSIQGMLDKVAPALLPALFTLLVYYLIKEKKWTTYKLVILTVIIGIIGSWLKIIA

SEQ ID NO: 625 - protein, 494 aa, Streptococcus pneumoniae
MKKQAFSSEQYLNLQRDHILERINQFDGKLYLEFGGKMLEDFHAARVLPGYEPDNKIKLLQELKEQVEVVIAINASNIEHSKARGDLGISYDQEVLRLIDKFNELGIFVGSVVITQYAGQPAADAFRNQLEKNGIDSYLHYPIKGYPTDMDHIISPEGMGKNDYIKTSRNLIVVTAPGPGSGKLATCMSNMYHDQINGIKSGYAKFETFPVWNLPLHHPVNLAYEAATADLDDVNMIDPFHLQTYGETTVNYNRDIEIFPVLKRMLERILGKSPYASPTDMGVNMVGFAITDDEAAVEASKQEIIRRYYQTVLDFKAEKVGEAAVKKIELLMNDLGITPADRKVAVVARQKAEETGGPALAFELPNGEIITGKNSELFGPTAAALINAIKKSADIAKEVKLIEPEVVKPIQGLKIDHLGSRNPRLHSNEILIALAITATENPDAARAMEELGNLKGSEAHSTIILTDEDKNVLRKLGINVTFDPYYQYDRLYRK

SEQ ID NO: 626 - protein, 719 aa, Streptococcus pneumoniae
MNKPTILRLIKYLSISFLSLVIAAIVLGGGVFFYYVSKAPSLSESKLVATTSSKIYDNKNQLIADLGSERRVNAQANDIPTDLVKAIVSIEDHRFFDHRGIDTIRILGAFLRNLQSNSLQGGSTLTQQLIKLTYFSTSTSDQTISRKAQEAWLAIQLEQKATKQEILTYYINKVYMSNGNYGMQTAAQNYYGKDLNNLSLPQLALLAGMPQAPNQYDPYSHPEAAQDRRNLVLSEMKNQGYISAEQYEKAVNTPITDGLQSLKSASNYPAYMDNYLKEVINQVEEETGYNLLTTGMDVYTNVDQEAQKHLWDIYNTDEYVAYPDDELQVASTIVDVSNGKVIAQLGARHQSSNVSFGINQAVETNRDWGSTMKPITDYAPALEYGVYDSTATIVHDEPYNYPGTNTPVYNWDRGYFGNITLQYALQQSRNVPAVETLNKVGLNRAKTFLNGLGIDYPSIHYSNAISSNTTESDKKYGASSEKMAAAYAAFANGGTYYKPMYIHKVVFSDGSEKEFSNVGTRAMKETTAYMMTDMMKTVLTYGTGRNAYLAWLPQAGKTGTSNYTDEEIENHIKTSQFVAPDELFAGYTRKYSMAVWTGYSNRLTPLVGNGLTVAAKVYRSMMTYLSEGSNPEDWNIPEGLYRNGEFVFKNGARSTWNSPAPQQPPSTESSSSSSDSSTSQSSSTTPSTNNSTTTNPNNNTQQSNTTPDQQNQNPQPAQP

SEQ ID NO: 627 - protein, 113 aa, Streptococcus pneumoniae
MERDMASIIFSAKDIFEQEFGREVRGYNKVEVDEFLDDVIKDYETYAALVKSLRQEIADLKEELTRKPKPSPVQAEPLEAAITSSMTNFDILKRLNRLEKEVFGKQILDNSDF

SEQ ID NO: 628 - protein, 464 aa, Streptococcus pneumoniae
MSKKRRNRHKKEGQEPQFDFDEAKELTVGQAIRKNEEVESGVLPEDSILDKYVKQHRDEIEADKFATRQYKKEEFVETQSLDDLIQEMREAVEKSEASSEEVPSSEDILLPLPLDDEEQGLDPLLLDDENPTEMTEEVEEEQNLSRLDQEDSEKKSKKGFILTVLALVSVIICVSAYYVYRQVARSTKEIETSQSTTANQSDVDDFNTLYDAFYTDSNKTALKNSQFDKLSQLKTLLDKLEGSREHTLAKSKYDSLATQIKAIQDVNAQFEKPAIVDGVLDTNAKAKSDAKFTDIKTGNTELDKVLDKAISLGKSQQTSTSSSSSSQTSSSSSSQASSNTTSEPKPSSSNETRSSRSEVNMGLSSAGVAVQRSASRVAYNQSAIDDSNNSAWDFADGVLEQILATSRSRGYITGDQYILERVNIVNGNGYYNLYKPDGTYLFTLNCKTGYFVGNGAGHADDLDY

SEQ ID NO: 629 - protein, 481 aa, Streptococcus pneumoniae
MKQEECQMTKANFGVVGMAVMGRNLALNIESRGYTVAIYNRSKEKTEDVIACHPEKNFVPSYDVESFVNSIEKPRRIMLMVQAGPGTDATIQALLPHLDKGDILIDGGNTFYKDTIRRNEELANSGINFIGTGVSGGEKGALEGPSIMPGGQKEAYELVADVLEEISAKAPEDGKPCVTYIGPDGAGHYVKMVHNGIEYGDMQLIAESYDLMQHLLGLSAEDMAEIFTEWNKGELDSYLIEITADILSRKDDEGQDGPIVDYILDAAGNKGTGKWTSQSSLDLGVPLSLITESVFARYISTYKEERVHASKVLPKPAAFNFEGDKAELIEKIRQALYFSKIISYAQGFAQLRVASKENNWNLPFADIASIWRDGCIIRSRFLQKITDAYNRDADLANLLLDEYFLDVTAKYQQAVRDIVALAVQAGVPVPTFSAAITYFDSYRSADLPANLIQAQRDYFGAHTYQRKDKEGTFHYSWYDEK

SEQ ID NO: 630 - protein, 144 aa, Streptococcus pneumoniae
MDYQRINEYLTSIFNNVLVIEEVNLRGSRFKDISIKEMHTIDVIGKAPDVTPSQVSKELMVTLGTVTTSLNNLERKGYIERVRSEQDRRVVHLHLTKKGRLIHRLHKRFHKAMVEKIIDGMSEEEIAVMGKGLTNLYQFLEDLK

SEQ ID NO: 631 - protein, 74 aa, Streptococcus pneumoniae
MAVFEKVQEIIVEELGKDASEVTLESTFDDLDADSLDLFQVISEIEDAFDIQIEAENDLKTVGDLVAYVEEQAK

SEQ ID NO: 632 - protein, 774 aa, Streptococcus pneumoniae
MVVKTVVEAQDIFDKAWEGFKGVDWKEKASVSRFVQANYTPYDGDESFLAGPTERSLHIKKIVEETKAHYEETRFPMDTRPTSIADIPAGFIDKENEVIFGIQNDELFKLNFMPKGGIRMAETTLKENGYEPDPAVHEIFTKYVTTVNDGIFRAYTSNIRRARHAHTVTGLPDAYSRGRIIGVYARLALYGADYLMQEKVNDWNAIKEIDEETIRLREEVNLQYQALQQVVRLGDLYGVDVRKPAMNVKEAIQWVNIAFMAVCRVINGAATSLGRVPIVLDIFAERDLARGTFTESEIQEFVDDFVMKLRTVKFARTKAYDQLYSGDPTFITTSMAGMGNDGRHRVTKMDYRFLNTLDNIGNSPEPNLTVLWTDKLPYNFRRYCMHMSHKHSSIQYEGVTTMAKDGYGEMSCISCCVSPLDPENEEQRHNIQYFGARVNVLKALLTGLNGGYDDVHKDYKVFDIEPIRDEVLEFESVKANFEKSLDWLTDTYVDALNIIHYMTDRYNYEAVQMAFLPTKQRANMGFGICGFANTVDTLSAIKYATVKPIRDEDGYIYDYETIGDYPRWGEDDPRSNELAEWLIEAYTTRLRSHKLYKDAEATVSLLTITSNVAYSKQTGNSPVHKGVYLNEDGSVNLSKLEFFSPGANPSNKAKGGWLQNLNSLSSLDFSYAADGISLTTQVSPRALGKTRDEQVDNLVTILDGYFENGGQHVNLNVMDLNDVYEKIMSGEDVIVRISGYCVNTKYLTPEQKTELTQRVFHEVLSMDDALDALS

SEQ ID NO: 633 - protein, 535 aa, Streptococcus pneumoniae
MSTKYIFVTGGVVSSIGKGIVAASLGRLLKNRGLKVTIQKFDPYINIDPGTMSPYQHGEVFVTDDGAETDLDLGHYERFIDINLNKYSNVTTGKIYSEVLRKERRGEYLGATVQVIPHITDALKEKIKRAALTTDSDVIITEVGGTVGDIESLPFLEALRQMKADVGADNVMYIHTTLLPYLKAAGEMKTKPTQHSVKELRGLGIQPNMLVIRTEEPAGQGIKNKLAQFCDVAPEAVIESLDVEHLYQIPLNLQAQGMDQIVCDHLKLDAPAADMTEWSAMVDKVMNLKKQVKISLVGKYVELQDAYISVVEALKHSGYVNDAEVKINWVNANDVTAENVAELLSDADGIIVPGGFGQRGTEGKIQAIRYARENDVPMLGVCLGMQLTCIEFARHVLGLEGANSAELAPETKYPIIDIMRDQIDIEDMGGTLRLGLYPSKLKRGSKAAAAYHNQEVVQRRHRHRYEFNNAFREQFEAAGFVFSGVSPDNRLVEIVEIPENKFFVACQYHPELSSRPNRPEELYTAFVTAAVENSN

SEQ ID NO: 634 - protein, 378 aa, Streptococcus pneumoniae
MNNTEFYDRLGVSKNASADEIKKAYRKLSKKYHPDINKEPGAEDKYKEVQEAYETLSDDQKRAAYDQYGAAGANGGFGGAGGFGGFNGAGGFGGFEDIFSSFFGGGGSSRNPNAPRQGDDLQYRVNLTFEEAIFGTEKEVKYHREAGCRTCNGSGAKPGTSPVTCGRCHGAGVINVDTQTPLGMMRRQVTCDVCHGRGKEIKYPCTTCHGTGHEKQAHSVHVKIPAGVETGQQIRLAGQGEAGFNGGPYGDLYVVVSVEASDKFEREGTTIFYNLNLNFVQAALGDTVDIPTVHGDVELVIPEGTQTGKKFRLRSKGAPSLRGGAVGDQYVTVNVVTPTGLNDRQKVALKEFAAAGDLKVNPKKKGFFDHIKDAFDGE

SEQ ID NO: 635 - protein, 95 aa, Streptococcus pneumoniae
MKLSNLLLFAGAAAGSYLVTKNRQTITDEVLNTTDRVQAIKDDVDIIQNSLQIINQQKELIKEYQEDLTYKFKVLEKDIQTRLAVIKEMQGTEDK

SEQ ID NO: 636 - protein, 378 aa, Streptococcus pneumoniae
MSKEMLEAFRILEEDKGIKKEDIIDAVVESLRSAYRRRYGQSDSVAIDFNEKTGDFTVYTVREVVDEVFDSRLEISLKDALAINSAYELGDKIKFEEAPAEFGRVAAQSAKQTIMEKMRKQTRAITYNTYKEHEQEIMSGTVERFDNRFIYVNLGSIEAQLSKQDQIPGEVFASHDRIEVYVYKVEDNPRGVNVFVSRSHPEMIKRLMEQEIPEVYDGTVEIMSVAREAGDRTKVAVRSHNPNVDAIGTIVGRGGANIKKITSKFHPARYDAKNDRMVPIEENIDVIEWVADPAEFIYNAIAPAEVDQVIFDENDSKRALVVVPDNKLSLAIGRRGQNVRLAAHLTGYRIDIKSASEFEAMEDAASVELEVENDTVEE

SEQ ID NO: 637 - protein, 958 aa, Streptococcus pneumoniae
MSKKRLYEIAKELGKESKEVVARAKELGLDVKSHSSSVEEAVAAKIAASFKPAAAPKVEAKPAAPKVSAEKKAEKSEPAKPAVAKEEAKPAAPKASAEKKAEKSEPVKPAVAKEEAKPAEPVTPKTEKVAAKPQSRNFKAEREARAKEQAERRKQNKGNNRDQQQNGNRQKNDGRNGGKQGQSNRDNRRFNDQAKKQQGQQKRRNERRQQEDKRSNQAAPRIDFKARAAALKAEQNAEYARSSEERFKQYQAAKEALAQANKRKEPEEIFEEAAKLAEQAQQVQAVVEVVPEKKEPAVDTRRKKQARPDKNRDDYDHEEDGPRKQQKNRSSQNQVRNQKNSNWNNNKKNKKGNNKNNRNQTPKPVTERKFHELPTEFEYTDGMTVAEIAKRIKREPAEIVKKLFMMGVMATQNQSLDGETIELLMVDYGIEAKQKVEVDNADIERFFVEDGYLNEDELVERPPVVTIMGHVDHGKTTLLDTLRNSRVATGEAGGITQHIGAYQIVENGKKITFLDTPGHAAFTSMRARGASVTDITILVVAADDGVMPQTIEAINHSKAANVPIIVAINKIDKPGANPERVIGELAEHGVMSTAWGGDSEFVEISAKFNQNIEELLETVLLVAEIQELKADPTVRAIGTVIEARLDKGKGAVATLLVQQGTLNVQDPIVVGNTFGRVRAMTNDLGRRVKVAGPSTPVSITGLNEAPMAGDHFAVYEDEKSARAAGEERAKRALMKQRQATQRVSLENLFDTLKAGELKSVNVIIKADVQGSVEALSASLQKIDVEGVKVTIVHSAVGAINESDVTLAEASNAFIVGFNVRPTPQARQQAEADDVEIRLHSIIYKVIEEMEEAMKGMLDPEFEEKVIGEAVIRETFKVSKVGTIGGFMVINGKVARDSKVRVIRDGVVIYDGELASLKHYKDDVKEVTNGREGGLMIDGYNDIKMDDVIEAYVMEEIKR

SEQ ID NO: 638 - protein, 293 aa, Streptococcus pneumoniae
MAIVSAEKFVQAARDNGYAVGGFNTNNLEWTQAILRAAEAKKAPVLIQTSMGAAKYMGGYKVARNLIANLVESMGITVPVAIHLDHGHYEDALECIEVGYTSIMFDGSHLPVEENLKLAKEVVEKAHAKGISVEAEVGTIGGEEDGIIGKGELAPIEDAKAMVETGIDFLAAGIGNIHGPYPVNWEGLDLDHLQKLTEALPGFPIVLHGGSGIPDEQIQAAIKLGVAKVNVNTECQIAFANATRKFARDYEANEAEYDKKKLFDPRKFLADGVKAIQASVEERIDVFGSEGKA

SEQ ID NO: 639 - protein, 141 aa, Streptococcus pneumoniae
MAKKVEKLVKLQIPAGKATPAPPVGPALGQAGINIMGFTKEFNARTADQAGMIIPVVISVYEDKSFTFVTKTPPAAVLLKKAAGVEKGSGTPNKTKVATVTRAQVQEIAETKMPDLNAANVESAMRMIEGTARSMGFTVVD

SEQ ID NO: 640 - protein, 229 aa, Streptococcus pneumoniae
MAKKSKQLRAALEKIDSTKAYSVEEAVALAKETNFAKFDATVEVAYNLNIDVKKADQQIRGAMVLPNGTGKTSRVLVFARGAKAEEAKAAGADFVGEDDLVAKINDGWLDFDVVIATPDMMALVGRLGRVLGPRNLMPNPKTGTVTMDVAKAVEESKGGKITYRADRAGNVQAIIGKVSFEAEKLVENFKAFNETIQKAKPATAKGTYVTNLTITTTQGVGIKVDVNSL

SEQ ID NO: 641 - protein, 620 aa, Streptococcus pneumoniae
MNIIEEIMTKLREDIRNIAIIAHVDHGKTTLVDELLKQSETLDARTELAERAMDSNDIEKERGITILAKNTAVAYNGTRINIMDTPGHADFGGEVERIMKMVDGVVLVVDAYEGTMPQTRFVLKKALEQDLVPIVVVNKIDKPSARPAEVVDEVLELFIELGADDDQLDFPVVYASAINGTSSLSDDPADQEATMAPIFDTIIDHIPAPVDNSDEPLQFQVSLLDYNDFVGRIGIGRVFRGTVKVGDQVTLSKLDGTTKNFRVTKLFGFFGLERREIQEAKAGDLIAVSGMEDIFVGETITPTDAVEALPILHIDEPTLQMTFLVNNSPFAGKEGKWVTSRKVEERLQAELQTDVSLRVDPTDSPDKWTVSGRGELHLSILIETMRREGYELQVSRPEVIVKEIDGIKCEPFERVQIDTPEEYQGSVIQSLSERKGEMLDMISTGNGQTRLVFLVPARGLIGYSTEFLSMTRGYGIMNHTFDQYLPLIPGEIGGRHRGALVSIDAGKATTYSIMSIEERGTIFVNPGTEVYEGMIIGENSRENDLTVNITKAKQMTNVRSATKDQTAVIKTPRILTLEESLEFLNDDEYMEVTPESIRLRKQILNKAEREKANKKKKSAE

SEQ ID NO: 642 - protein, 378 aa, Streptococcus pneumoniae
MSYKTSNAEGHVDFINTYDLEPMAQQVIPKAAFGYIASGAEDTFTLRENIRAFNHKLIVPHTLCNVENPSTEIEFAGEKLSSPIIMAPVAAHKLANEQGEVATARGVHEFGSLYTTSSYSTVDLPEISEALQGTPHWFQFYFSKDDGINRHIMDRVKAEGYKAIVLTADATVGGNREVDKRNGFVFPVGMPIVEEYLPEGAGKSMDFVYKSAKQRLSPRDVEFIAEYSGLPVYVKGPQCREDVERSLAAGASGIWVTNHGGRQIDGGPAAFDSLQEVAEAVDRRVPIVFDSGVRRGQHVFKALASGADLVAIGRPVIYGLALGGSVGVRQVFEHLNAELKTVMQLSGTQTIEDVKHFKLRHNPYNPTFPVDPRDLKLY

SEQ ID NO: 643 - protein, 314 aa, Streptococcus pneumoniae
MSEPLFLQSVMQEKIWGGAKLRDEFGYDIPSEKIGEYWAISAHPNGVSKVANGRYEGTDLATLYAEHRELFGNRPEPVFPLLTKILDANDWLSVQVHPDDAYGLEHEGELGKTECWYIIAADEGSEIIYGHNAKSKEELRQQIEDKNWDDLLTKVPVKAGDFFYVPSGTMHAIGAGILILETQQSSDTTYRVYDFDRKDDKGNLRELHLEKSIDVLNIGEPANSRPVTVKADDLRSTLLVSNDFFAVYKWEITGKVDFEKTADYSLLSVLAGQGQLTVDGKNYPIQKGSHFILPSDVEAWTLEGQGLELIVSHP

SEQ ID NO: 644 - protein, 281 aa, Streptococcus pneumoniae
MTWKIIADSGCDYRQLPTPAINTTFVSVPLTIQVADQVFVDDASLDIDQMMETMYATAEASKSACPSPDDYLRAFEGAKNIFLVTITGTLSGSHNSAQLAKNIYLEDHPDTKIHVIDSLSAGGEVDLLVEKLNDLIDQGLSFEEVVEAITAYQEKTKLLFVLAKVDNLVKNGRLSKLIGTVVGLLNIRMVGKASETGTLELLQKARGSKKSVQAAYDELVKAGYAGGRIVMAQRNNEKCCQQLSERIRETFPQADIKILPTSGLCSFYAEEGGLLMGYEID

SEQ ID NO: 645 - protein, 216 aa, Streptococcus pneumoniae
MKEGIPKMGKIEVINHPLIQHKLSILRRTDTSTKAFRELVDEIAMLMGYEVLRDLPLEDVEIETPITKTVQKQLAGKKLAIVPILRAGIGMVDGLLNLVPAAKVGHIGMYRDEETLQPVEYLVKLPEDIDQRQIFVVDPMLATGGSAILAVDSLKKRGASNIKFVCLVSAPEGVKALQEAHPDVEIFTAALDERLNEHGYIVPGLGDAGDRLFGTK

SEQ ID NO: 646 - protein, 252 aa, Streptococcus pneumoniae
MISPSATQDGLTKGQDYLFIGTFQDSFQGKIISNYVSEKLNAKKVVLYTDNASDYAKGIAKSFRESYKGEIVADETFVAGDTDFQAALTKMKGKDFDAIVVPGYYNEAGKIVNQARGMGIDKPIVGGDGFNGEEFVQQATAEKASNIYFISGFSTTVEVSAKAKAFLDAYRAKYNEEPSTFAALAYDSVHLVANAAKGAKNSGEIKNNLAKTKDFEGVTGQTSFDADHNTVKTAYMMTMNNGKVEAAEVVKP

SEQ ID NO: 647 - protein, 396 aa, Streptococcus pneumoniae
MSERKLFTSESVSEGHPDKIADQISDAILDAILAKDPEAHVAAETAVYTGSVHVFGEISTNAYVDINRVVRDTIAEIGYTNTEYGFSAETVGVHPSLVEQSPDIAQGVNEALEVRGNADQDPLDLIGAGDQGLMFGFAVDETEELMPLPIALSHKLVRRLAELRKSGEISYLRPDAKSQVTVEYDENDRPVRVDTVVISTQHDPEATNEQIHQDVIDKVIKEVIPSSYLDDKTKFFINPTGRFVIGGPQGDSGLTGRKIIVDTYGGYSRHGGGAFSGKDATKVDRSASYAARYIAKNIVAADLAKKAEVQLAYAIGVAQPVSVRIDTFGTGTVAESQLEKAARQIFDLRPAGIIQMLDLKRPIYRQTSAYGHMGRTDIDLPWERLDKVDALKEAVK

SEQ ID NO: 648 - protein, 90 aa, Streptococcus pneumoniae
MAVKIRLTRMGSKKKPFYRINVADSRSPRDGRFIETVGTYNPLVAENQVTLKEDRVLAWLANGAQPSDTVRNILSKEGVLKKFHDSKFSK

SEQ ID NO: 649 - protein, 112 aa, Streptococcus pneumoniae
MQVIKRNGEIAEFNPDKIYQAILKAAQTVYVLTDDLRQNLAQVTKKVVLDLQEAKVERATISMIQSMVEHRLLGAGYITIAEHYISYRLQRDLERSGYGDHIAVHLHFEQIR

SEQ ID NO: 650 - protein, 752 aa, Streptococcus pneumoniae
MLCQNCKINDSTIHLYTNLNGKQKQIDLCQNCYKIIKTDPNNSLFKGMTDLNNRDFDPFGDFFNDLNNFRPSSNTPPIPPTQSGGGYGGNGGYGSQNRGSAQTPPPSQEKGLLEEFGINVTEIARRGDIDPVIGRDDEIIRVIEILNRRTKNNPVLIGEPGVGKTAVVEGLAQKIVDGDVPHKLQGKQVIRLDVVSLVQGTGIRGQFEERMQKLMEEIRKREDIILFIDEIHEIVGAGSASDGNMDAGNILKPALARGELQLVGATTLNEYRIIEKDAALERRMQPVKVDEPTVDETITILKGIQKKYEDYHHVQYTDAAIEAAATLSNRYIQDRFLPDKAIDLLDEAGSKMNLTLNFVDPKVIDQRLIEAENLKSQATREEDFEKAAYFRDQIAKYKEMQKKKITDQDTPSISEKTIEHIIEQKTNIPVGDLKEKEQSQLIHLAEDLKSHVIGQDDAVDKIAKAIRRNRVGLGTPNRPIGSFLFVGPTGVGKTELSKQLAIELFGSADSMIRFDMSEYMEKHSVAKLVGAPPGYVGYDEAGQLTEKVRHNPYSLILLDEVEKAHPDVMHMFLQVLDDGRLTDGQGRTVSFKDAIIIMTSNAGTGKTEASVGFGAAREGRTNSVLGELGNFFSPEFMNRFDGIIEFKALSKDNLLQIVELMLADVNKRLSSNNIRLDVTDKVKEKLVDLGYDPKMGARPLRRTIQDYIEDTITDYYLENPSEKDLKAVMTSKGNIQIKSAKKAEVKSSEKEK

SEQ ID NO: 651 - protein, 400 aa, Streptococcus pneumoniae
MNEFEDLLNSVSQVETGDVVSAEVLTVDATQANVAISGTGVEGVLTLRELTNDRDADINDFVKVGEVLDVLVLRQVVGKDTDTVTYLVSKKRLEARKAWDKLVGREEEVVTVKGTRAVKGGLSVEFEGVRGFIPASMLDTRFVRNAERFVGQEFDTKIKEVNAKENRFILSRREVVEAATAAARAEVFGKLAVGDVVTGKVARITSFGAFVDLGGVDGLVHLTELSHERNVSPKSVVTVGEEIEVKILDLNEEEGRVSLSLKATVPGPWDGVEQKLAKGDVVEGTVKRLTDFGAFVEVLPGIDGLVHVSQISHKRIENPKEALKVGQEVQVKVLEVNADAERVSLSIKALEERPAQEEGQKEEKRAARPRRPRRQEKRDFELPETQTGFSMADLFGDIEL

SEQ ID NO: 652 - protein, 470 aa, Streptococcus pneumoniae
MAEERVEPKPIDLGEYKFGFHDDVEPVLSTGKGLNEGVIRELSAAKGEPEWMLEFRLKSYETFKKMPMQTWGADLSEIDFDDLIYYQKPSDKPARSWDDVPEKIKETFERIGIPEAERAYLAGASAQYESEVVYHNMKEEFQKLGIIFTDTDSALKEYPDLFKQYFAKLVPPTDNKLAALNSAVWSGGTFIYVPKGVKVDIPLQTYFRINNENIGQFERTLIIVDEGASVYYVEGCTAPTYSSNSLHAAIVEIFALDGAYMRYTTIQNWSDNVYNLVTKRAKAQKDATVEWIDGNLGAKTTMKYPSVYLDGEGARGTMLSIAFANAGQHQDTGAKMIHNAPHTSSSIVSKSIAKGGGKVDYRGQVTFNKNSKKSVSHIECDTIIMDDLSASDTIPFNEIHNSQVALEHEAKVSKISEEQLYYLMSRGLSESEATEMIVMGFVEPFTKELPMEYAVELNRLISYEMEGSVG

SEQ ID NO: 653 - protein, 413 aa, Streptococcus pneumoniae
MKKIFLTLLTVSLLGGASTAVAQDFTIAAKHAIAVEANTGKILYEKDATQPVEIASITKLITVYLVYEALENGSITLSTPVDISDYPYQLTTNSEASNIPMEARNYTVEELLEATLVSSANSAAIALAEKIAGSEKDFVDMMRAKLLEWGIQDATVVNTTGLNNETLGDNIYPGSKKDEENKLSAYDVAIVARNLIKKYPQVLEITKKPSSTFAGMTITSTNYMLEGMPAYRGGFDGLKTGTTDKAGESFVGTTVEKGMRVITVVLNADHQDNNPYARFTATSSLMDYISSTFTLRKIVQQGDAYQDSKAPVQDGKEDTVTAVAPEDIYLIERVGNQSSQSVQFTPDSKAIPAPLEAGTVVGHLTYEDKDLIGQGYITTERPSFEMVADKKIEKAFFLKVWWNQFVRFVNEKL

SEQ ID NO: 654 - protein, 335 aa, Streptococcus pneumoniae
MKRIAVLTSGGDAPGMNAAIRAVVRQAISEGMEVFGIYDGYAGMVAGEIHPLDAASVGDIISRGGTFLHSARYPEFAQLEGQLKGIEQLKKHGIEGVVVIGGDGSYHGAMRLTEHGFPAIGLPGTIDNDIVGTDFTIGFDTAVTTAMDAIDKIRDTSSSHRRTFVIEVMGRNAGDIALWAGIATGADEIIIPEAGFKMEDIVASIKAGYECGKKHNIIVLAEGVMSAAEFGQKLKEAGDTSDLRVTELGHIQRGGSPTARDRVLASRMGAHAVKLLKEGIGGVAVGIRNEKMVENPILGTAEEGALFSLTAEGKIVVNNPHKADIELSSLNKSLS

SEQ ID NO: 655 - protein, 501 aa, Streptococcus pneumoniae
MNKRVKIVATLGPAVEIRGGKKFGEDGYWGEKLDVEASAKNIAKLIEAGANTFRFNFSHGDHQEQGERMATVKLAEKIAGKKVGFLLDTKGPEIRTELFEGEAKEYSYKTGEKIRVATKQGIKSTREVIALNVAGALDIYDDVEVGRQVLVDDGKLGLRVVAKDDATREFEVEVENDGIIAKQKGVNIPNTKIPFPALAERDNDDIRFGLEQGINFIAISFVRTAKDVNEVRAICEETGNGHVQLFAKIENQQGIDNLDEIIEAADGIMIARGDMGIEVPFEMVPVYQKMIIKKVNAAGKVVITATNMLETMTEKPRATRSEVSDVFNAVIDGTDATMLSGESANGKYPLESVTTMATIDKNAQALLNEYGRLDSDSFERNSKTEVMASAVKDATSSMDIKLVVTLTKTGHTARLISKYRPNADILALTFDELTERGLMLNWGVIPMLTDAPSSTDDMFEIAERKAVEAGLVESGDDIVIVAGVPVGEAVRTNTMRIRTVR

SEQ ID NO: 656 - protein, 491 aa, Streptococcus pneumoniae
MKELDQNQAPIYEALVKLRKKRIVPFDVPGHKRGRGNPELVELLGEKCVGIDVNSMKPLDNLGHPISIIRDAEELAADAFGASHAFLMIGGTTSSVQTMILATCKAGDKIILPRNVHKSAINALVLCGAIPIYIEMSVDPKIGIALGLENDRVAQAIKDHPDAKAILINNPTYYGICSDLKGLTEMAHEAGMMVLVDEAHGAHLHFTDKLPISAMDAGADMAAVSMHKSGGSLTQSSILLIGEQMNSEYVRQIINLTQSTSASYLLMASLDISRRNLALRGKESFEKVIELSEYARREINAIGGYYAYSKELIDGVSVCDFDVTKLSVYTQGIGLTGIEVYDLLRDEYDIQIEFGDIGNILAYISIGDRIQDIERLVGALADIKRLYSRDGKDLIAGEYIQPELVLSPQEAFYSERKSLTLDDSVGQVCGEFVMCYPPGIPILAPGERITREIVDYIQFAKERGCSLQGTEDPEVNHINVIKRKTNYKKSQ

SEQ ID NO: 657 - protein, 286 aa, Streptococcus pneumoniae
MDLWFSEVHTPDVKLSLRTAKQLYAGKSEWQDIEVLDTPAFGKILILNGHVLFSDADDFVYNEMTVHVPMAVHPNPKKVLVIGGGDGGVAQVLTLYPELEQIDIVEPDEMLVEVCREYFPDFAAGLDDPRVTIYYQNGLRFLRNCEDDYDIIINDATDPFGHTEGLFTKEFYGNSYRALKEDGIMIYQHGSPFFDEDESACRSMHRKVNQAFPISRVYQAHIPTSPAGYWLFGFASKKYHPVKDFDKEGWKKRQLFTEYYTANLHVGAFMLPKYVEDILEEEEGKK

SEQ ID NO: 658 - protein, 291 aa, Streptococcus pneumoniae
MRNVRVATIQMQCAKDVATNIQTAERLVRQAAEQGAQIILLPELFEHPYFCQERQYDYYQYAQSVAENTAIQHFKVIAKELQVVLPISFYEKDGNVLYNSIAVIDADGEVLGVYRKTHIPDDHYYQEKFYFTPGNTGFKVWNTRYAKIGIGICWDQWFPETARCLALNGAELLFYPTAIGSEPILDTDSCGHWQRTMQGHAAANIVPVIAANRYGLEEVTPSEENGGQSSSLDFYGSSFMTDETGAILERAERQEEAVLLATYDLDKGASERLNWGLFRDRRPEMYRQITD

SEQ ID NO: 659 - protein, 119 aa, Streptococcus pneumoniae
MARVKGGVVSRKRRKRILKLAKGYYGAKHILFRTAKEQVMNSYYYAYRDRRQKKRDFRKLWITRINAAARMNGLSYSQLMHGLKLAEIEVNRKMLADLAVNDAVAFTALADAAKAKLGK

SEQ ID NO: 660 - protein, 181 aa, Streptococcus pneumoniae
MEFEEKTLSRKEIYQGPIFKLVQDQVELPEGKGTAQRDLIFHNGAVCVLAVTDEQKLILVKQYRKAIEAVSYEIPAGKLEVGENTAPVAAALRELEEETAYTGKLELLYDFYSAIGFCNEKLKLYLASDLTKVENPRPQDEDETLEVLEVSLEEAKELIQSGHICDAKTIMAVQYWELQKK

SEQ ID NO: 661 - protein, 191 aa, Streptococcus pneumoniae
MNKGGQMKKVMFAGLSLLSLVVLMACGEEETKKTQAAQQPKQQTTVQQIAVGKDAPDFTLQSMDGKEVKLSDFKGKKVYLKFWASWCGPCKKSMPELMELAAKPDRDFEILTVIAPGIQGEKTVEQFPQWFQEQGYKDIPVLYDTKATTFQAYQIRSIPTEYLIDSQGKIGKIQFGAISNADAEAAFKEMN

SEQ ID NO: 662 - protein, 418 aa, Streptococcus pneumoniae
MIFDKDDFKAYDADLWNAIAKEEERQQNNIELIASENVVSKAVMAAQGSILTNKYAEGYPGRRYYGGTDVVDVVETLAIERAKEIFGAKFANVQPHSGSQANCAAYMSLIEPGDTVMGMDLASGGHLTHGAPVSFSGQTYNFVSYSVDPKTELLDFDAILKQAQEVKPKLIVAGASAYSQIIDFSKFREIADAVGAKLMVDMAHIAGLVAAGLHPSPVPYAHITTTTTHKTLRGPRGGLILTNDEELAKKINSAIFPGIQGGPLEHVVAAKAVSFKEVLDPAFKEYAANVIKNSKAMADVFLQDPDFRIISGGTENHLFLVDVTKVVENGKVAQNLLDEVNITLNKNSIPYESLSPFKTSGIRIGAAAITARGFGEEESRKVAELIIKTLKNSENEAVLEEVRSAVKELTDAFPLYED

SEQ ID NO: 663 - protein, 341 aa, Streptococcus pneumoniae
MKNKFFLIAILAMCIVFSACSSNSVKNEENTSKEHAPDKIVLDHAFGQTILDKKPERVATIAWGNHDVALALGIVPVGFSKANYGVSADKGVLPWTEEKIKELNGKANLFDDLDGLNFEAISNSKPDVILAGYSGITKEDYDTLSKIAPVAAYKSKPWQTLWRDMIKIDSKALGMEKEGDELIKNTEARISKELEKHPEIKGKIKGKKVLFTMINAADTSKFWIYTSKDPRANYLTDLGLVFPESLKEFESEDSFAKEISAEEANKINDADVIITYGDDKTLEALQKDPLLGKINAIKNGAVAVIPDNTPLAASCTPTPLSINYTIEEYLNLLGNACKNAK

SEQ ID NO: 664 - protein, 898 aa, Streptococcus pneumoniae
MSLQKLENYSNKSVVQEEVLILTELLEDITKNMLAPETFEKIIQLKELSTQEDYQGLNRLVTSLSNDEMVYISRYFSILPLLINISEDVDLAYEINHQNNIDQDYLGKLSTTIKLVAEKENAVEILEHLNVVPVLTAHPTQVQRKSMLDLTNHIHSLLRKYRDVKLGLINKDKWYNDLRRYIEIIMQTDMIREKKLKVTNEITNAMEYYNSSFLKAVPHLTTEYKRLAQAHGLNLKQAKPITMGMWIGGDRDGNPFVTAKTLKQSALTQCEVIMNYYDKKIYQLYREFSLSTSIVNVSKQVREMARQSKDNSIYREKELYRRALFDIQSKIQATKTYLIEDEEVGTRYETANDFYKDLIAIRDSLLENKGESLISGDFVELLQAVEIFGFYLASIDMRQDSSVYEACVAELLKSAGIHSRYSELSEEEKCDLLLKELEEDPRILSATHAEKSELLAKELAIFKTARVLKDKLGDDVIRQTIISHATSLSDMLELAILLKEVGLVDTERARVQIVPLFETIEDLDHSEETMRKYLSLSLAKKWIDSRNNYQEIMLGYSDSNKDGGYLSSCWTLYKAQQQLTAIGDEFGVKVTFFHGRGGTVGRGGGPTYEAITSQPLKSIKDRIRLTEQGEVIGNKYGNKDAAYYNLEMLVSAAINRMITQKKSDTNTPNRYETIMDQVVDRSYDIYRDLVFGNEHFYDYFFESSPIKAISSFNIGSRPAARKTITEIGGLRAIPWVFSWSQSRVMFPGWYGVGSSFKEFINKNPENIAILRDMYQNWPFFQSLLSNVDMVLSKSNMNIAFEYAKLCEDEQVKAIYETILNEWQVTKNVILAIEGHDELLADNPYLKASLDYRMPYFNILNYIQLELIKRQRRGELSSDQERLIHITINGIATGLRNSG

SEQ ID NO: 665 - protein, 115 aa, Streptococcus pneumoniae
MAFEKIIQLKNCRYDYTLSPSVKKFTLKDNTFFETKVGNYELTRLLEKVPNSGEGFQLKIIINKELTGAKINITDKFGLRLVDIFKSEDHHIHQEKFYFLMDSLVERGVFTKSER

SEQ ID NO: 666 - protein, 319 aa, Streptococcus pneumoniae
MSDRKNMKLFALNSNQEIAQKIAQAVGVPLGKLSSRQFSDGEIQVNIEESVRGYDVYIIQSTSFPVNNHLMELLIMVDACVRASAHSINVVLPYFGYARQDRIACPREPLTAKLVANMLVKAGVDRILTLDLHAVQVQGFFDIPVDNLFTVPLFAKHYCDKGLLGSDVVVVSPKNSGVKRARSLAEYLDAPIAIIDYPQDDATRNEGYIIGDVEGKKAILIDDILNTGRTFSEASKIVEREGATEIYAVSSHGLFVEGAAELLDNTNIKEILVTDSVATKEKTPKNVCYITASELIGDAIVRIHERKPVSPLFAYNKKK

SEQ ID NO: 667 - protein, 474 aa, Streptococcus pneumoniae
MTRYQNLVNGKWKSSEQEITIYSPINQEELGTVPAMTQTEADEAMQAARAALPAWRALSAVERAAYLHKTAAILERDKEEIGTILAKEVAKGIKAAIGEVVRTADLIRYAAEEGLRITGQAMEGGGFEATSKNKLAVVRREPVGIVLAIAPFNYPVNLSASKIAPALIAGNVVMFKPPTQGSISGLLLAKAFEEAGIPAGVFNTITGRGSEIGDYIIEHKEVNFINFTGSTPIGERIGRLAGMRPIMLELGGKDAALVLEDADLEHAAKQIVAGAFSYSGQRCTAIKRVIVLESVADKLATLLQEEVSKLTVGDPFDNADITPVIDNASADFIWGLIEDAQEKEAQALTPIKREGNLLWPVLFDQVTKDMKVAWEEPFGPVLPIIRVASVEEAIAFANESEFGLQSSVFTNDFKKAFEIAEKLEVGTVHINNKTQRGPDNFPFLGVKGSGAGVQGIKYSIEAMTNVKSIVFDVK

SEQ ID NO: 668 - protein, 326 aa, Streptococcus pneumoniae
MALTEQKRVRLEKLSDENGIISALAFDQRGALKRLMVKHQTEEPTVAQMEELKVLVADELTKYASSMLLDPEYGLPATKALDEKAGLLLAYEKTGYDTTSTKRLPDCLDVWSAKRIKEEGADAVKFLLYYDVDSSDELNQEKQAYIERIGSECVAEDIPFFLEILAYDEKIADAGSVEYAKVKPHKVIGAMKVFSDPRFNIDVLKVEVPVNIKYVEGFAEGEVVYTREEAAAFFKAQDEATNLPYIYLSAGVSAKLFQDTLVFAHESGANFNGVLCGRATWAGSVEAYIKDGEAAARECVRTTGFENIDELNKVLQRTATSWKERV

SEQ ID NO: 669 - protein, 171 aa, Streptococcus pneumoniae
MRIAIGCDHIVTDEKMAVSEFLKSKGYEVIDFGTYDHTRTHYPIFGKKVGEAVTSGQADLGVCICGTGVGINNAVNKVPGVRSALVRDMTTALYAKEQLNANVIGFGGKITGELLMCDIIEAFIHAEYKPTEENKKLIAKIEHVESHNAQQTDANFFTEFLEKWDRGEYHD

SEQ ID NO: 670 - protein, 141 aa, Streptococcus pneumoniae
MSIVIGADAAGLRLKEVVKDFLEKENFHLVDVTAEGQDFVDVTLAVAAEVNKEEQNLGIVIDAYGAGPFIVATKIKGMVAAEVSDERSAYMTRGHNNSRMITMGAQLVGDELAKNIAKGFVNGKYDGGRHQIRVDMLNKMG

SEQ ID NO: 671 - protein, 628 aa, Streptococcus pneumoniae
MVLSKYQKQFIINRYPERKRIMNLEELKKRQEKIRNFSIIAHIDHGKSTLADRILEKTETVSSREMQAQLLDSMELERERGITIKLNAIELNYTAKDGETYIFHLIDTPGHVDFTYEVSRSLAACEGAILVVDAAQGIEAQTLANVYLALDNDLEIMPIINKIDLPAADPERVRTEIEDVIGLDASEAVLASAKAGIGIEEILEQIVEKVPAPTGDVTAPLKALIFDSVYDAYRGVILQVRVMDGVVKPGDKIQLMSNSKTFDVAEVGIFTPKAVGRDFLATGDVGYIAASIKTVQDTRVGDTVTLATNPAAEPLHGYKQMNPMVFAGLYPIESNKYNDLREALEKLQLNDASLQFEPETSQALGFGFRCGFLGLLHMDVIQERLEREFNIDLIMTAPSVIYKVNLTDGESMDVSNPSEFPDPTKIATIEEPYVKAQIMVPQEFVGAVMELAQRKRGDFVTMDYIDDNRVNVIYQIPLAEIVFDFFDKLKSSTRGYASFDYELSEYRPSKLVKMDILLNGDKVDALSFIVHKDFAYERGKLIVDKLKKIIPRQQFEVPIQAAIGHKIVARTDIKALRKNVLAKCYGGDVSRKRKLLEKQKAGKKRMKSIGSVEVPQEAFLSVLSMDEE

SEQ ID NO: 672 - protein, 448 aa, Streptococcus pneumoniae
MEMEKYLSVTTLTKYLKMKFDKDPYLERVYLTGQVSNFRKRPTHQYFSLKDDHAVIQATIWSGIYQKLGFDLEEGMKINVIGRVQVYEPSGSYSIIIEKAEPDGVGALAIQFEQLKKKLTEEGLFQERFKQALPQFSKRIGVVTSRSGAVIRDIITTVSRRFPGVDILLYPTKVQGEGAAEEIARNIARANQRDDLDLLIIGRGGGSIEDLWAFNEEIVVRAIFESRLPVISSVGHETDVTLADFVADRRAATPTAAAELATPVTKLDVLAHLQNQEKRMVTAVRNVLSKKQEALKKCSQSVIFRQPERLYDGYLQRLDQLQLRLKQSLRTRISDNKQLVQARTHQLVQLSPVTKIQRYQDRLGQLDKLLGSQMALVYDAKVAEAKRLSEALLMLDTSRIVARGYAIVKKEESVVDSVESLKKKDQVTLLMRDGQVELEVKDVKTKEI

SEQ ID NO: 673 - protein, 247 aa, Streptococcus pneumoniae
MSQKNNKKKNKRKNLLTNILAGFLILLSLALIFNTQIRNIFIVWNTNKYQVSQVSKEKLEENQDTEGNFDFDSVKAISSEAVLTSQWDAQKLPVIGGIAIPELEMNLPIFKGLDNVNLFYGAGTMKREQVMGEGNYSLASHHIFGVDNANKMLFSPLDNAKNGMKIYLTDKNKVYTYEIREVKRVTPDRVDEVDDRDGVNEITLVTCEDLAATERIIVKGDLKETKDYSQTSNEILTAFNQPYKQFY

SEQ ID NO: 674 - protein, 332 aa, Streptococcus pneumoniae
MFKTMTSTKQHKKVILVGDGAVGSSYAFALVNQGIAQELGIIEIPQLHEKAVGDALDLSHALAFTSPKKIYAAQYSDCADADLVVITAGAPQKPGETRLDLVGKNLAINKSIVTQVVESGFKGIFLVAANPVDVLTYSTWKFSGFPKERVIGSGTSLDSARFRQALAEKLDVDARSVHAYIMGEHGDSEFAVWSHANIAGVNLEEFLKDTQNVQEAELIELFEGVRDAAYTIINKKGATYYGIAVALARITKAILDDENAVLPLSVFQEGQYGVENVFIGQPAVVGAHGIVRPVNIPLNDAETQKMQASAKELQAIIDEAWKNPEFQEASKN

SEQ ID NO: 675 - protein, 183 aa, Streptococcus pneumoniae
MANILLAVTGSIASYKSADLVSSLKKQGHQVTVLMTQAATEFIQPLTLQVLSQNPVHLDVMKEPYPDQVNHIELGKKADLFIVVPATANTIAKLAHGFADNMVTSTALALPSHIPKLIAPAMNTKMYDHPVTQNNLKTLETYGYQLIAPKESLLACGDHGRGALADLTIILERIKETIDEKTL

SEQ ID NO: 676 - protein, 289 aa, Streptococcus pneumoniae
MEKIIKEKISSLLSQEEEVLSVEQLGGMTNQNYLAKTTNKQYIVKFFGKGTEKLINRQDEKYNLELLKDLGLDVKNYLFDIEAGIKVNEYIESAITLDSTSIKTKFDKITPILQTIHTSAKELRGEFAPFEEIKKYESLIEEQIPYANYESVRNAVFSLEKRLADLGVDRKSCHIDLVPENFIESPQGRLYLIDWEYSSMNDPMWDLAALFLESEFTSQEEETFLSHYESDQTPVSHEKIAIYKILQDTIWSLWTVYKEEQGEDFGDYGVNRYQRAIKGLASYGGSDEK

SEQ ID NO: 677 - protein, 267 aa, Streptococcus pneumoniae
MKQLTVEDAKQIELEILDYIDTLCKKHNINYIINYGTLIGAVRHEGFIPWDDDIDLSMPREDYQRFINIFQKEKSKYKLLSLETDKNYFNNFIKITDSTTKIIDTRNTKTYESGIFIDIFPIDRFDDPKVIDTCYKLESFKLLSFSKHKNIVYKDSLLKDWIRTAFWLLLRPVSPRYFANKIEKEIQKYSRENGQYMAFIPSKFKEKEVFPSGTFDKTIDLPFENLSLPAPEKFDTILTQFYGDYMTLPPEEKRFYSHEFHAYKLED

SEQ ID NO: 678 - protein, 115 aa, Streptococcus pneumoniae
MNPLIQSLTEGQLRTDIPSFRPGDTVRVHAKVVEGNRERIQIFEGVVIARKGAGISENYTVRKISNGVGVERIFPIHTPRVEKIEVVRYGKVRRAKLYYLRALQGKAARIKEIRR

SEQ ID NO: 679 - protein, 147 aa, Streptococcus pneumoniae
MALAKIVFASMTGNTEEIADIVADKLRDLGLDVDVDECTTVDASDFLEADIAIVATYTYGDGELPDEMMDFYEDLADLNLNGKIYGVVGSGDTFYDEFCKAVDDFDRVFVSTGAEKGSECVKVDLSAEEEDIERLEQFAEELAAKVG

SEQ ID NO: 680 - protein, 127 aa, Streptococcus pneumoniae
MEEITMALNIENIIAEIKEASILELNDLVKAIEEEFGVTAAAPVAVAAADAADAGAAKDSFDVELTSAGDKKVGVIKVVREITGLGLKEAKELVDGAPALVKEGVATAEAEEIKAKLEEAGASVTLK

SEQ ID NO: 681 - protein, 170 aa, Streptococcus pneumoniae
MNTLMSEAIIAKKAELVDVVAEKMKAAASIVVVDARGLTVEQDTVLRRELRGSEVEYKVIKNSILRRAAEKAGLEDLASVFVGPSAVAFSNEDVIAPAKILNDFSKNAEALEIKGGAIEGAVASKEEILALATLPNREGLLSMLLSVLQAPVRNVALAVKAVAESKEDAA

SEQ ID NO: 682 - protein, 596 aa, Streptococcus pneumoniae
MKSMHPNMERRTRMKRQTVNQTLKRLAVDLASHPFLLFLAFLGTIAQVGLSIYLPILIGQVIDQVLVAGSSPVFWQIFLQMLLVVIGNTLVQWANPLLYNRLIFSYTRDLRERIIHKLHRLPIAFVDRQGSGEMVSRVTTDIEQLAAGLTMIFNQFFIGVLMILVSILAMLQIHLLMTLLVLLLTPLSMVISRFIAKKSYHLFQKQTETRGIQTQLIEESLSQQTIIQSFNAQTEFIQRLREAHDNYSGYSQSAIFYSSTVNPSTRFVNALIYALLAGVGAYRIMMGSALTVGRLVTFLNYVQQYTKPFNDISSVLAELQSALACVERIYGVLDSPEVAETGKEVLTTSDQVKGAISFKHVSFGYHPEKILIKDLSIDIPAGSKVAIVGPTGAGKSTLINLLMRFYPISSGDILLDGQSIYDYTRVSLRQQFGMVLQETWLTQGTIHDNIAFGNPEASREQVIAAAKAANADFFIQQLPQGYDTKLENAGESLSVGQAQLLTIARVFLAIPKILILDEATSSIDTRTEVLVQDAFAKLMKGRTSFIIAHRLSTIQDADLILVLVDGDIVEYGNHQELMDRKGKYYQMQKAAAFSSE

SEQ ID NO: 683 - protein, 344 aa, Streptococcus pneumoniae
MFEHYSVADLFANLYKKRKANILALIALFALIAVPFTIKAVRNKNTVKDTTSYSTYLIYKITPPKESDKTILNHQIGGYSDFYGKLIDGNLNGAYLFNDVEPSELKKIASELDTTETTLKNSTNDYWWKKLTVYYMIDDAGVGVKILTSSKDANNLLEKKIDGLIEKFKHAYANVKIEKLETINSKELNANGETALGLNVKNLILRLVVIGVVCVILVVMGNVLVYLFNPTINRVGDFSQYQIDFVTEITTIANLADVLSYKNTGQELTIVSSNKAILDKLKQSQEALKGMHFVDLQDVSSLLERDTVLLVEEYGVTRYKKFEQSLQILRNLNRSILGVATFKL

SEQ ID NO: 684 - protein, 424 aa, Streptococcus pneumoniae
MSKENPLSHHEQLRYDYLLKNIHYLNEREKNEFAYLQEKLTLARGNSSSSLEQEREEQVDLPSYANRSRSQSKSQALSFPPKKKRRKLRLKRIFMVIFSLLVCVALAMVFMFLRGYQDASAKKTADARAAQVEVFNGQDTRDGVNILIMGTDGRIGQNSVETRTDSIMVLNVGGSDKKMKLVSFMRDNLVYIDGYSQVINGRKQTDNKLNVAYELGEQEGQKGAEMVRQVLKDNFDLDIKYYALVDFQAFATAIDTLFPDGVTIDAQFSTLNGRPLTEATVGDDLYATETESPTQTIKVGKQQMNGSTLLNYARFRDDDEADYGRTKRQQQVLTAILEQIKDPTKLFTGSEALGKVFAMTSTNVPYTFLLTNGLSVLDGAKNGIEKLTIPELGDWVDAYDVYGGLGLLVDQNKYQTKLAQMGLR

SEQ ID NO: 685 - protein, 267 aa, Streptococcus pneumoniae
MSTYNWDEKHILTFPEEKVALSTKDVHVYYGKNESIKGIDMQFERNKITALIGPSGSGKSTYLRSLNRMNDTIDIAKVTGQILYRGIDVNRPEINVYEMRKHIGMVFQRPNPFAKSIYRNITFAHERAGVKDKQVLDEIVETSLRQAALWDQVKDDLHKSALTLSGGQQQRLCIARAISVKPDILLMDEPASALDPIATMQLEETMFELKKNFTIIIVTHNMQQAARASDYTGFFYLGDLIEYDKTATIFQNAKLQSTNDYVSGHFG

SEQ ID NO: 686 - protein, 459 aa, Streptococcus pneumoniae
MSKIVVVGANHAGTACINTMLDNFGNENEIVVFDQNSNISFLGCGMALWIGEQIDGAEGLFYSDKEKLEAKGAKVYMNSPVLSIDYDNKVVTAEVEGKEHKESYEKLIFATGSTPILPPIEGVEIVKGNREFKATLENVQFVKLYQNAEEVINKLSDKSQHLDRIAVVGGGYIGVELAEAFERLGKEVVLVDIVDTVLNGYYDKDFTQMMAKNLEDHNIRLALGQTVKAIEGDGKVERLITDKESFDVDMVILAVGFRPNTALAGGKIELFRNGAFLVDKKQETSIPDVYAVGDCATVYDNARKDTSYIALASNAVRTGIVGAYNACGHELEGIGVQGSNGISIYGLHMVSTGLTLEKAKAAGYNATETGFNDLQKPEFMKHDNHEVAIKIVFDKDSREILGAQMVSHDIAISMGIHMFSLAIQEHVTIDKLALTDLFFLPHFNKPYNYITMAALTAEK

SEQ ID NO: 687 - protein, 404 aa, Streptococcus pneumoniae
MEAFTQMAKEKYDRSKPHVNIGTIGHVDHGKTTLTAAITTVLARRLPSSVNQPKDYASIDAAPEERERGITINTAHVEYETEKRHYAHIDAPGHADYVKNMITGAAQMDGAILVVASTDGPMPQTREHILLSRQVGVKHLIVFMNKVDLVDDEELLELVEMEIRDLLSEYDFPGDDLPVIQGSALKALEGDSKYEDIVMELMNTVDEYIPEPERDTDKPLLLPVEDVFSITGRGTVASGRIDRGIVKVNDEIEIVGIKEETQKAVVTGVEMFRKQLDEGLAGDNVGVLLRGVQRDEIERGQVIAKPGSINPHTKFKGEVYILTKEEGGRHTPFFNNYRPQFYFRTTDVTGSIELPAGTEMVMPGDNVTIDVELIHPIAVEQGTTFSIREGGRTVGSGMVTEIEA

SEQ ID NO: 688 - protein, 289 aa, Streptococcus pneumoniae
MDFTWALKYATEFLGTAILIILGNGAVANVELKGTKGHQSGWIVIAVGYGMGVMIPALMFGNVSGNHINPAFTLGLAVSGLFPWAQVVPYIIAQVLGAIFGQALVVATYRPFYLKTENPNNILGTFSTISSIDHGTKESRYAATVNGLINEFVGSFVLFFAALGLTKNFFGAEVLQFMKQKATEAGQTVDFSDLAIKAQVAPHTASGLSVAHLALGFLVMALVTSLGGPTGPALNPARDLGPRLLHAFLPKSVLGEHKGDSKWWYSWVPVVAPIAAAIAAVAVFKFLYL

SEQ ID NO: 689 - protein, 468 aa, Streptococcus pneumoniae
MSSGKIAQVIGPVVDVLFAAGEKLPEINNALVVYKNDERKTKIVLEVALELGDGMVRTIAMESTDGLTRGMEVLDTGRPISVPVGKETLGRVFNVLGDTIDLEAPFTEDAERQPIHKKAPTFDELSTSSEILETGIKVIDLLAPYLKGGKVGLFGGAGVGKTVLIQELIHNIAQEHGGISVFAGVGERTREGNDLYWEMKESGVIEKTAMVFGQMNEPPGARMRVALTGLTIAEYFRDVEGQDVLLFIDNIFRFTQAGSEVSALLGRMPSAVGYQPTLATEMGQLQERITSTKKGSVTSIQAIYVPADDYTDPAPATAFAHLDSTTNLERKLVQLGIYPAVDPLASSSRALAPEIVGEEHYAVAAEVKRVLQRYHELQDIIAILGMDELSDEEKTLVARARRIQFFLSQNFNVAEQFTGQPGSYVPVAETVRGFKEILDGKYDHLPEDAFRGVGSIEDVIAKAEKMGF

SEQ ID NO: 690 - protein, 292 aa, Streptococcus pneumoniae
MAVSLNDIKTKIASTKNTSQITNAMQMVSAAKLGRSEEAARNFQVYAQKVRKLLTDILHGNGAGASTNPMLISRSVKKTGYIVITSDRGLVGGYNSSILKAVMELKEEYHPDGKGFEMICIGGMGADFFKARGIQPLYELRGLSDQPSFDQVRKIISKTVEMYQNELFDELYVCYNHHVNTLTSQMRVEQMLPIVDLDPNEADEEYSLTFELETSREEILEQLLPQFAESMIYGAIIDAKTAENAAGMTAMQTATDNAKKVINDLTIQYNRARQAAITQEITEIVAGASALE

SEQ ID NO: 691 - protein, 501 aa, Streptococcus pneumoniae
MAINAQEISALIKQQIENFKPNFDVTETGVVTYIGDGIARAHGLENVMSGELLNFENGSYGMAQNLESTDVGIIILGDFTDIREGDTIRRTGKIMEVPVGESLIGRVVDPLGRPVDGLGEIHTDKTRPVEAPAPGVMQRKSVSEPLQTGLKAIDALVPIGRGQRELIIGDRQTGKTTIAIDTILNQKDQDMICIYVAIGQKESTVRTQVETLRQYGALDYTIVVTASASQPSPLLFLAPYAGVAMAEEFMYQGKHVLIVYDDLSKQAVAYRELSLLLRRPPGREAFPGDVFYLHSRLLERSAKVSDELGGGSITALPFIETQAGDISAYIATNVISITDGQIFLGDGLFNAGIRPAIDAGSSVSRVGGSAQIKAMKKVAGTLRIDLASYRELEAFTKFGSDLDAATQAKLNRGRRTVEVLKQPVHKPLPVEKQVTILYALTHGFLDTVPVDDIVRFEEEFHAFFDAQHPEILETIRDTKDLPEEAVLDAAITEFLNQSSFQ

SEQ ID NO: 692 - protein, 178 aa, Streptococcus pneumoniae
MDKKTVKVIEKYSMPFVQLVLEKGEEDRIFSDLTQIKQVVEKTGLPSFLKQVAVDESDKEKTIAFFQDSVSPLLQNFIQVLAYNHRANLFYDVLVDCLNRLEKETNRFEVTITSAHPLTDEQKTRLLPLIEKKMSLKVRSVKEQIDESLIGGFVIFANHKTIDVSIKQQLKVVKENLK

SEQ ID NO: 693 - protein, 164 aa, Streptococcus pneumoniae
MHVTVGELIGNFILITGSFILLLVLIKKFAWSNITGIFEERAEKIASDIDRAEEARQKAEVLAQKREDELAGSRKEAKTIIENAKETAEQSKANILADAKLEAGHLKEKANQEIAQNKVEALQSVKGEVADLTISLAGKIISQNLDSHAHKALIDQYIDQLGEA

SEQ ID NO: 694 - protein, 466 aa, Streptococcus pneumoniae
MDAKLRYKAKKIKIVFFDIDDTLRNSKTGFIPTTIPTVFKQLREKGILTGIASGRGIFGVVPEIRDLKPDFFVTLNGAYIEDKKGQVIYQHQIEKSDVEEYISWAKQEGIEYGLVGSHDAKLSTRTDMMSEAINPIYPDLDVDPDFHEKEDIYQMWTFEDKGDDLHLPDSLSDKLRMVRWHQHSSDIVPISGSKATGVEKVVEHLGLKPEKVMVFGDGLNDLELFDYAGISVAMGISHDKIKEKADYITKTLEEDGIFAALEVFGMVEKELHFPQVDIETVEGPLATIKTNHGDLRIKLFPEHAPKTVANFVSLSKDGYYDGVIFHRIIKDFMIQGGDPTGTGMGGESIYGESFEDEFSEELYNIRGALSMANAGPNTNGSQFFIVQNQHLPYSKKEITRGGWPEPIAEIYANQGGTPHLDRRHTVFGQLADEASYAVLDAIAAVETGAMDKPVEDVVIETIEIED

SEQ ID NO: 695 - protein, 79 aa, Streptococcus pneumoniae
MAQQRRGGFKRRKKVDYIAANKIEYVDYKDTELLSRFVSERGKILPRRVTGTSAKNQRKVTTAIKRARVMALMPFVNED

SEQ ID NO: 696 - protein, 96 aa, Streptococcus pneumoniae
MAKYEILYIIRPNIEEEAKNALVARFDSILTDNGATVVESKTWEKRRLAYEIQDFREGLYHIVNVEANDDAALKEFDRLSKINADILRHMIVKIDA

SEQ ID NO: 697 - protein, 531 aa, Streptococcus pneumoniae
MKRIVFELIFIATTWYIFLPPLNLTSWEFLFFLCGHLLVVAILFGFGKGINLVKTVHVRHGKAEAALNLEGFKINRLGKILLASIGGILLLAALVSLVTSSMFQAKNYANVVTVTEKDFTEFPKSDTSKVPILDRSTAEKIGDRYLGSLTDKVSQYVAADTYTQLTIDGKPYRVTPLEYADPIKWFNNQAKGIGEYIKVDMVTGNADLVDLKTPIKYSDSEYFNRDVKRHLRLKYPTKIFKTPSFEVDDEGNPFYVATVYQKQFGLAVPRPASVIILDATNGETKEYSLSDVPEWVDRIYPAEETIEQINYNGKYKDGFLNAMISKKNVTQTTNGYNYLSIGNDIYLYTGVTSANADESNLGFILENMRTGEITKYSLASATEESARESAEGAVQEKSYKATFPILINLNDKPLYIMGLKDNAGLVKEYALVDAVEYQNVIVATTVEEMLSKYANKNDLEIDNATTESINGVVADLKSAVIKGDTVYFFKVDGKIYKVKASVSDDLPYLENGKTFEGQVGKDNYLKTFKLR

SEQ ID NO: 698 - protein, 914 aa, Streptococcus pneumoniae
MTERESVLHTMSRRRHMSKEQKRQAFYTQSPEEVLQAVDATEQGLSSSEAEKRLAEFGHNELEEGEKRSILVKFIEQFKDLMIIILVAAAILSVVTSGGEDIADAIIILAVVIINAAFGVYQEGKAEEAIEALKSMSSPVARVLRDGHMAEIDSKELVPGDIVALEAGDVVPADLRLIEANSLKIEEAALTGESVPVEKDLSVELATDAGIGDRVNMAFQNSNVTYGRGMGVVVNTGMYTEVGHIAGMLQDADETDTPLKQNLNNLSKVLTYAILVIALVTFVVGVFIQGKNPLGELLTSVALAVAAIPEGLPAIVTIVLSLGTQVLAKRHSIVRKLPAVETLGSTEIIASDKTGTLTMNKMTVEKVFYDAVLHDSADDIELGLEMPLLRSVVLANDTKIDVEGNLIGDPTETAFIQYALDKGYDVKGFLEKYPRVAELPFDSDRKLMSTVHPLPDGRFLVAVKGAPDQLLKRCLLRDKAGDIAPIDEKVTNLIRTNNSEMAHQALRVLAGAYKIIDSIPENLTSEELENDLIFTGLIGMIDPERPEAAEAVRVAKEAGIRPIMITGDHQDTAEAIAKRLGIIDANDTEGHVLTGAELNELSDEEFEKVVGQYSVYARVSPEHKVRIVKAWQKQGKVVAMTGDGVNDAPALKTADIGIGMGITGTEVSKGASDMILADDNFATIIVAVEEGRKVFSNIQKTIQYLLSANTAEVLTIFLSTLFGWDVLQPVHLLWINLVTDTFPAIALGVEPAEPGVMNHKPRGRKASFFSGGVLSSIIYQGVLQAALVMSVYGLAIAYPVHVGDNHAIHADALTMAFATLGLIQLFHAYNVKSVYQSILTVGPFKSKTFNWSILVSFILLMATIVVEPLEGIFHVTKLDLSQWGIVMAGSFSMIIIVEIVKFIQRKLGFDKNAI

SEQ ID NO: 699 - protein, 292 aa, Streptococcus pneumoniae
MIGRISGMNFQQLSNLQYWTSLFASPWTIAINLIDILIVAYILYHFTKAIAGTKIMILVRGVLVFILAQILANMIGLTTISWLINQIITYGVIAAVVIFSPEIRTGLERLGRATDFFSNAPISAEEQMIRAFVKSVEYMSPRKIGALVAIQRVRTLQEYISTGIPLDAKISAELLINIFIPNTPLHDGAVIIKEERIAVTSAYLPLTKNTGISKEFGTRHRAAIGLSEVSDALTFVVSEETGGISITYNGRFKHNLTLDEFETELREILLPKEEVGLSFKERLLGGWKHEKK

SEQ ID NO: 700 - protein, 410 aa, Streptococcus pneumoniae
MSTNRKNDMMVYCSFCGKNQEEVQKIIAGNNAFICNECVELAQEIIREELVEEVLADLSEVPKPIELLHILNHYVIGQDRAKRALAVAVYNHYKRINFHDTREESEDVDLQKSNILMIGPTGSGKTFLAQTLAKSLNVPFAIADATALTEAGYVGEDVENILLKLLQVADFNIERAERGIIYVDEIDKIAKKSENVSITRDVSGEGVQQALLKIIEGTVASVPPQGGRKHPQQEMIQVDTKNILFIVGGAFDGIEEIVKQRLGEKVIGFGQNNKAIDENSSYMQEIIAEDIQKFGIIPELIGRLPVFAALEQLTVDDLVRILKEPRNALVKQYQTLLSYDDVELEFDDEALQEIANKAIERKTGARGLRSIIEETMLDVMFEVPSQENVKLVRITKETVDGTDKPILETA

SEQ ID NO: 701 - protein, 376 aa, Streptococcus pneumoniae
MVELNLKNIYKKYPNSEHYSVEDFNLNIKDKEFIVFVGPSGCGKSTTLRMIAGLEDITEGTASIDGVVVNDVAPKDRDIAMVFQNYALYPHMTVYDNMAFGLKLRKYSKEDINKRVQEAAEILGLKEFLERKPADLSGGQRQRVAMGRAIVRDAKVFLMDEPLSNLDAKLRVSMRAEIAKIHRRIGATTIYVTHDQTEAMTLADRIVIMSATKNPAGTGTIGRVEQIGTPQEVYKNPVNKFVAGFIGSPAMNFITVKLVGSEIVSDGFRLKVPEGALKVLREKGYEGKELIFGIRPEDVNAEPAFLETFPDCVVKATISVSELLGSESHLYCQVGKDEFVAKVDARDYLQTGATVELGFDLNKAHFFDVETEKTIY

SEQ ID NO: 702 - protein, 524 aa, Streptococcus pneumoniae
MKFNELNLSADLLAEIEKAGFVEASPIQEQTIPLALEGKDVIGQAQTGTGKTAAFGLPTLEKIRTEEATIQALVIAPTRELAVQSQEELFRFGRSKGVKVRSVYGGSSIEKQIKALKSGAHIVVGTPGRLLDLIKRKALKLQDIETLILDEADEMLNMGFLEDIEAIISRVPENRQTLLFSATMPDAIKRIGVQFMKAPEHVKIAAKELTTELVDQYYIRVKEQEKFDTMTRLMDVAQPELAIVFGRTKRRVDELTRGLKIRGFRAEGIHGDLDQNKRLRVLRDFKNGNLDVLVATDVAARGLDISGVTHVYNYDIPQDPESYVHRIGRTGRAGKSGQSITFVAPNEMGYLQIIENLTKKRMKGLKPASVEESFQSKKQVALKKIERDFADETIRANFEKFGKDARKLAAEFTPEELAMYILSLTVQDPDSLPEVEIAREKPLPFKPSGNGFGGKAKGGRGGRRGDDRRERDRRGNGRRDEFKKGSRGNDRFDKEKRYRKDNKKPRNTLSEKQTGFVIRNKGDK

SEQ ID NO: 703 - protein, 438 aa, Streptococcus pneumoniae
MLTYDLIVIGFGKAGKTLAGKLASAGKKVALVERSKAMYGGTCINIGCIPTKTLLVAAEKDLSFEEVIATKNTITGRLNGKNYATVAGTGVDIFDAEAHFLSNKVIEIQAGDEKKELTAETIVINTGAVSNVLPIPGLATSKNIFDSTGIQSLDKLPEKLGILGGGNIGLEFAGLYNKLGSKVTVLDALDTFLPRAEPSIAALAKQYMEEDGIELLQNIHTTEIKNDGDQVLVVTEDETYRFDALLYATGRKPNVEPLQLENTDIELTERGAIKVDKHCQTNVPGVFAVGDVNGGLQFTYISLDDFRVVYSYLAGDGSYTLEDRLNVPNTMFITPALSQVGLTESQAADLKLPYAVKEIPVAAMPRGHVNGDLRGAFKAVVNTETKEILGASIFSEGSQEIINIITVAMDNKIPYTYFTKQIFTHPTLAENLNDLFAI

SEQ ID NO: 704 - protein, 778 aa, Streptococcus pneumoniae
MDKNKIMGLTQREVKERQAEGLVNDFTASASTSTWQIVKRNVFTLFNALNFAIALALAFVQAWSNLVFFAVICFNAFSGIVTELRAKHMVDKLNLMTKEKVKTIRDGQEVALNPEELVLGDVIRLSAGEQIPSDALVLEGFAEVNEAMLTGESDLVQKEVDGLLLSGSFLASGSVLSQVHHVGADNYAAKLMLEAKTVKPINSRIMKSLDKLAGFTGKIIIPFGLALLLEALLLKGLPLKSSVVNSSTALLGMLPKGIALLTITSLLTAVIKLGLKKVLVQEMYSVETLARVDMLCLDKTGTITQGKMQVEAVLPLTETYGEEAIASILTSYMAHSEDKNPTAQAIRQRFVGDVAYPMISNLPFSSDRKWGAMELEGLGTVFLGAPEMLLDSEVPEAREALERGSRVLVLALSQEKLDHHKPQKPSDIQALALLEILDPIREGAAETLDYLRSQEVGLKIISGDNPVTVSSIAQKAGFADYHSYVDCSKITDEELMAMAEETAIFGRVSPHQKKLIIQTLKKAGHTTAMTGDGVNDILALREADCSIVMAEGDPATRQIANLVLLNSDFNDVPEILFEGRRVVNNIAHIAPIFLIKTIYSFLLAVICIASALLGRSEWILIFPFIPIQITMIDQFVEGFPPFVLTFERNIKPVEQNFLRKSMLRALPSALMVVFSVLFVKMFGASQGWSELEISTLLYYLLGSIGFLSVFRACMPFTLWRVLLIVWSVGGFLATALFPRIQKLLEISTLTEQTLPVYGVMMLVFTVIFILTSRYQAKK

SEQ ID NO: 705 - protein, 89 aa, Streptococcus pneumoniae
MAISKEKKNEIIAQYARHEGDTGSVEVQVAVLTWEINHLNEHIKQHKKDHATYRGLMKKIGRRRNLLAYLRKNDVNRYRELINSLGLRR

SEQ ID NO: 706 - protein, 630 aa, Streptococcus pneumoniae
MTRYQDDFYDAINGEWQQTAEIPADKSQTGGFVDLDQEIEDLMLATTDKWLAGEEVPEDAILENFVKYHRLVRDFDKREADGITPVLPLLKEFQELETFADFTAKLAEFELAGKPNFLPFGVSPDFMDARINVLWASAPSTILPDTTYYAEEHPQREELLTLWKESSANLLKAYDFSDEEIEDLLEKRLELDRRVAAVVLSNEESSEYAKLYHPYSYEDFKKFAPALPLDDFFKAVIGQLPDKVIVDEERFWQAAEQFYSEEAWSLLKATLILSVVNLSTSYLTEDIRVLSGAYSRALSGVPEAKDKVKAAYHLAQEPFKQALGLWYAREKFSPEAKADVEKKVATMIDVYKERLLKNDWLTPETCKQAIVKLNVIKPYIGYPEELPARYKDKVVNETASLFENALAFARVEIKHSWSKWNQPVDYKEWGMPAHMVNAYYNPQKNLIVFPAAILQAPFYDLHQSSSANYGGIGAVIAHEISHAFDTNGASFDENGSLKDWWTESDYAAFKEKTQKVIDQFDGQDSYGATINGKLTVSENVADLGGIAAALEAAKREADFSAEEFFYNFGRIWRMKGRPEFMKLLASVDVHAPAKLRVNVQVPNFDDFFTTYDVKEGDGMWRSPEERVIIW

SEQ ID NO: 707 - protein, 230 aa, Streptococcus pneumoniae
MVKLVFARHGESEWNKANLFTGWADVDLSEKGTQQAIDAGKLIKEAGIEFDQAYTSVLKRAIKTTNLALEASDQLWVPVEKSWRLNERHYGGLTGKNKAEAAEQFGDEQVHIWRRSYDVLPPNMDRDDEHSAHTDRRYASLDDSVIPDAENLKVTLERALPFWEDKIAPALKDGKNVFVGAHGNSIRALVKHIKGLSDDEIMDVEIPNFPPLVFEFDEKLNVVSEYYLGK

SEQ ID NO: 708 - protein, 179 aa, Streptococcus pneumoniae
MSLKDRFDRFIDYFTEDEDSSLPYEKRDEPVFTSVNSSQEPALPMNQPSQSAGTKENNITRLHARQQELANQSQRATDKVIIDVRYPRKYEDATEIVDLLAGNESILIDFQYMTEVQARRCLDYLDGACHVLAGNLKKVASTMYLLTPVNVIVNVEDIRLPDEDQQGEFGFDMKRNRVR

SEQ ID NO: 709 - protein, 457 aa, Streptococcus pneumoniae
MAREGFFTGLDIGTSSVKVLVAEQRNGELNVIGVSNAKSKGVKDGIIVDIDAAATAIKSAISQAEEKAGISIKSVNVGLPGNLLQVEPTQGMIPVTSDTKEITDQDVENVVKSALTKSMTPDREVITFIPEEFIVDGFQGIRDPRGMMGVRLEMRGLLYTGPRTILHNLRKTVERAGVQVENVIISPLAMVQSVLNEGEREFGATVIDMGAGQTTVATIRNQELQFTHILQEGGDYVTKDISKVLKTSRKLAEGLKLNYGEAYPPLASKETFQVEVIGEVEAVEVTEAYLSEIISARIKHILEQIKQELDRRRLLDLPGGIVLIGGNAILPGMVELAQEVFGVRVKLYVPNQVGIRNPAFAHVISLSEFAGQLTEVNLLAQGAIKGENDLSHQPISFGGMLQKTAQFVQSTPVQPAPAPEVEPVAPTEPMADFQQASQNKPKLADRFRGLIGSMFDE

SEQ ID NO: 710 - protein, 685 aa, Streptococcus pneumoniae
MRLICMRKFNSHSIPIRLNLLFSIVILLFMTIIGRLLYMQVLNKDFYEKKLASASQTKITSSSARGEIYDASGKPLVENTLKQVVSFTRSNKMTATDLKETAKKLLTYVSISSPNLTERQLADYYLADPEIYKKIVEALPSEKRLDSDGNRLSESELYNNAVDSVQTSQLNYTEDEKKEIYLFSQLNAVGNFATGTIATDPLNDSQVAVIASISKEMPGISISTSWDRKVLETSLSSIVGSVSSEKAGLPAEEAEAYLKKGYSLNDRVGTSYLEKQYEETLQGKRSVKEIHLDKYGNMESVDTIEEGSKGNNIKLTIDLAFQDSVDALLKSYFNSELENGGAKYSEGVYAVALNPKTGAVLSMSGIKHDLKTGELTPDSLGTVTNVFVPGSVVKAATISSGWENGVLSGNQTLTDQSIVFQGSAPINSWYTQAYGSFPITAVQALEYSSNTYMVQTALGLMGQTYQPNMFVGTSNLESAMEKLRSTFGEYGLGTATGIDLPDESTGFVPKEYSFANYITNAFGQFDNYTPMQLAQYVATIANNGVRVAPRIVEGIYGNNDKGGLGDLIQQLQPTEMNKVNISDSDMSILHQGFYQVAHGTSGLTTGRAFSNGALVSISGKTGTAESYVADGQQATNTNAVAYAPSDNPQIAVAVVFPHNTNLTNGVGPSIARDIINLYQKYHPMN

SEQ ID NO: 711 - protein, 301 aa, Streptococcus pneumoniae
MSELISVVVPIYNTGKYLVECVEHILKQTYQNIEIILVDDGSTDNSGEICDAFMMQDNRVRVLHQENKGGAAQAKNMGISVAKGEYITIVDSDDIVKENMIETLYQQVQEKDADVVIGNYYNYDESDGNFYFYVTGQDFCVEELAIQEIMNRQAGDWKFNSSAFILPTFKLIKKELFNEVHFSNGRRFDDEATMHRFYLLASKIVFINDNLYLYRRRSGSIMRTEFDLSWARDIVEVFSKKISDCVLAGLDVSVLRIRFVNLLKDYKQTLEYHQLTDTEEYKDICFRLKLFFDAEQRNGKS

SEQ ID NO: 712 - protein, 104 aa, Streptococcus pneumoniae
MAKAITDATFEQETKDGLVLVDFWATWCGPCRMQGPILDKLSEELSEDVLKIVKMDVDENPNTARAFGIMSIPTLLFKKDGQVVKQVAGVHTAEQIKAIIAELS

SEQ ID NO: 713 - protein, 202 aa, Streptococcus pneumoniae
MSNEKNTNTNVEKKDATVVAHEIKGELTYEDKVIQKIIGLSLENVSGLLGIDGGFFSNLKEKIVNSDDVTSGVNVEVGKTQVAVDLNVIVEYQKNVPALYSEIREIVSSEVAKMTDLEIVEINVNVVDIKTKEQHEADSVSLQDRVSDVAESTGEFTSEQFEKAKSGLGSGFSTVQEKVSEGVEAVKGAANGVVSHENTRVN

SEQ ID NO: 714 - protein, 583 aa, Streptococcus pneumoniae
MQNKQEQWTVLKRLMSYLKPYGLLTFLALSFLLATTVIKSVIPLVASHFIDQYLSNLNQLAVTVLLVYYGLYILQTVVQYVGNLLFARVSYSIVRDIRRDAFANMEKLGMSYFDKTPAGSIVSRLTNDTETISDMFSGILSSFISAVFIFLTTLYTMLVLDFRLTALVLLFLPLIFLLVNLYRKKSVKIIEKTRSLLSDINSKLAENIEGIRIIQAFNQEKRLQAEFDEINQEHLVYANRSVALDALFLRPAMSLLKLLGYAVLMAYFGYRGFSIGITVGTMYAFIQYINRLFDPLIEVTQNFSTLQTAMVSAGRVFALIDERTYEPLQENGQAKVQEGNIRFEHVCFSYDGKHPILDDISFSVNKGETIAFVGHTGSGKSSIINVLMRFYEFQSGRVLLDDVDIRDFSQEELRKNIGLVLQEPFLYHGTIKSNIAMYQETSDEQVQAAAAFVDADSFIQELPQGYDSPVSERGSSFSTGQRQLLAFARTVASQPKILILDEATANIDSETESLVQASLAKMRQGRTTIAIAHRLSTIQDANCIYVLDKGRIIESGTHEELLALGGTYHKMYSLQAGAMADTL

SEQ ID NO: 715 - protein, 153 aa, Streptococcus pneumoniae
MKTKQLVASEEVYDFLKVIWPDYETESRYDNLSLIVCTLSDPDCVRWLSENMKFGDEKQLALMKEKYGWEVGDKLPEWLHSSYHRLLLIGELLESNLKLKKYTVEITETLSRLVSIEAENPDEAERLVREKYKSCEIVLDADDFQDYDTSIYE

SEQ ID NO: 716 - protein, 336 aa, Streptococcus pneumoniae
MAGKRDSCGACRIMTNKIYEYKDDQDWYVGSYSIFGGVNSLSDYKTDFPLFEFSKIFGDEEYGFPLSVTVLRYGSIYRLFSFVVDMLNQEMGRNLEVIQRHGALLLVENGQLLYVELPKEGVNVHDFFETSKVRETLLIATRNEGKTKEFRAIFDKLGYDVENLNDYPDLPEVAETGMTFEENARLKAETISQLTGKMVLADDSGLKVDVLGGLPGVWSARFAGVGATDRENNAKLLHELAMVFELKDRSAQFHTTLVVASPNKESLVVEADWSGYINFEPKGENGFGYDPLFLVGETGESSAELTLEEKNSQSHRALAVKKLLEVFPSWQSKPSL

SEQ ID NO: 717 - protein, 100 aa, Streptococcus pneumoniae
MASLWYNERDSKRNRRKMMDLLLAIVLIVLAFLGGALGGMYLVRKQIEKEFADNPRLNAEAVRTLLSANGQKPSEAKVQQVYHQIIRQQKAALANNKKKK

SEQ ID NO: 718 - protein, 94 aa, Streptococcus pneumoniae
MLKPLGDRVVLKIEEKEQTVGGFVLAGSAQEKTKTAQVVATGQGVRTLNGDLVAPSVKTGDRVLVEAHAGLDVKDGDEKYIIVGEANILAIIEE

SEQ ID NO: 719 - protein, 158 aa, Streptococcus pneumoniae
MKGVTNMTPEEMYLTERLDVQIAHFLKKSVQHRRRYKVLKITEIVAGFLIAVFCAIPMPGDRYRLISVALSSLGLLCEGIINLYNAKENWISYQKTAQLLEKEKFLYQCQTEKYAGKTKAFALFVKTCEGLISEEINQWESIQSKEVAASADAPVKKE

SEQ ID NO: 720 - protein, 388 aa, Streptococcus pneumoniae
MAKKPKKLEEISKKFGAEREKALNDALKLIEKDFGKGSIMRLGERAEQKVQVMSSGSLALDIALGSGGYPKGRIIEIYGPESSGKTTVALHAVAQAQKEGGIAAFIDAEHALDPAYAAALGVNIDELLLSQPDSGEQGLEIAGKLIDSGAVDLVVVDSVAALVPRAEIDGDIGDSHVGLQARMMSQAMRKLGASINKTKTIAIFINQLREKVGVMFGNPETTPGGRALKFYASVRLDVRGNTQIKGTGDQKETNVGKETKIKVVKNKVAPPFKEAVVEIMYGEGISKTGELLKIASDLDIIKKAGAWYSYKDEKIGQGSENAKKYLAEHPEIFDEIDKQVRSKFGLIDGEEVSEQDTENKKDEPKKEEAVNEEVPLDLGDELEIEIEE

SEQ ID NO: 721 - protein, 1225 aa, Streptococcus pneumoniae
MVDVNRFKSMQITLASPSKVRSWSYGEVKKPETINYRTLKPEREGLFDEVIFGPTKDWECACGKYKRIRYRGIVCDRCGVEVTRTKVRRERMGHIELKAPVSHIWYFKGIPSRMGLTLDMSPRALEEVIYFAAYVVIDPKDTPLEHKSIMTEREYRERLREYGYGSFVAKMGAEAIQDLLKQVDLEKEIAELKEELKTATGQKRVKAIRRLDVLDAFYKSGNKPEWMILNILPVIPPDLRPMLQLDGGRFASSDLNDLYRRVINRNNRLARLLELNAPGIIVQNEKRMLQEAVDALIDNGRRGRPITGPGSRPLKSLSHMLKGKQGRFRQNLLGKRVDFSGRSVIAVGPTLKMYQCGVPREMAIELFKPFVMREIVARDIVQNVKAAKRLVERGDERIWDILEEVIKEHPVLLNRAPTLHRLGIQAFEPVLIDGKALRLHPLVCEAYNADFDGDQMAIHVPLSEEAQAEARILMLAAEHILNPKDGKPVVTPSQDMVLGNYYLTMEEAGREGEGMVFKDRDEAVMAYRNGYVHLHSRVGIATDSLNKPWTEEQRHKVLLTTVGKILFNDIMPEGLPYLQEPNNANLTEGVPAKYFLPLGGDIKEAISNLELNPPFKKKNLGNIIAEIFKRFRTTETSALLDRMKNLGYHHSTLAGLTVGIADIPVVDDKAEIIEESHKRVEQITKQFRRGMITDDERYNAVTAEWRAAREKLEKRLIANQDPKNPIVMMMDSGARGNISNFSQLAGMRGLMAAPNGRIMELPILSNFREGLSVLEMFFSTHGARKGMTDTALKTADSGYLTRRLVDVAQDVIIREDDCGTDRGLLIRSIAEGKEMIESLEERLNGRYTKKTVKHPETGAVIIGPNELITEDKAREIVNAGVEEVTIRSVFTCNTRHGVCRHCYGINLATGDAVEVGEAVGTIAAQSIGEPGTQLTMRTFHTGGVASNTDITQGLPRVQEIFEARNPKGEAVITEVKGQVTAIEEDASTRTKKVFVKGETGEGEYVVPFTARMRVEVGGQVARGAALTEGSIQPKRLLAVRDVLSVETYLLGEVQKVYRSQGVEIGDKHIEVMVRQMIRKVRVMDPGDTDLLMGTLMDINDFTDANKDVLIAGGVPATGRPVLMGITKASLETNSFLSAASFQETTRVLTDAAIRGKKDHLLGLKENVIIGKIIPAGTGMARYRNLEPHAVNEEEYLNPPVEEEGNEETTEVVVDTAVETVEETVE

SEQ ID NO: 722 - protein, 332 aa, Streptococcus pneumoniae
MSMKKSFIHQQEEISFVKNTFTQYLKDKLEVVEVQGPILSKVGDGMQDNLSGVENPVSVKVLQIPDATYEVVHSLAKWKRHTLARFGFGEGEGLFVHMKALRPDEDSLDATHSVYVDQWDWEKVIPNGKRNIVYLKETVEKIYKAIRLTELAVEARYDIESILPKQITFIHTEELVERYPDLTPKERENAICKEFGAVFLIGIGGELPDGKPHDGRAPDYDDWTSESENGYKGLNGDILVWNESLGGAFELSSMGIRVDEETLRRQVEITGDEDRLELEWHKSLLNGLFPLTIGGGIGQSRMAMFLLRKRHIGEVQTSVWPQEVRDTYENIL

SEQ ID NO: 723 - protein, 275 aa, Streptococcus pneumoniae
MKLRRSDRMVVISNYLINNPYKLTSLNTFAEKYESAKSSISEDIVIIKRAFEEIEIGHIQTVTGAGGGVIFTPSISSQDAKEMVEDLRTKLSESDRILPGGYIYLSDLLSTPAILKNIGRIIAKSFMDQKIDAVMTVATKGVPLANAVANVLNVSFVIVRRDLKITEGSTVSVNYVSGSSGDRIEKMFLSKRSLKAGSRVLIVDDFLKGGGTVNGMISLLREFDSELAGVAVFADNAQEEREKQFDYKSLLKVTNIDVKNQAIDVEVGNIFDEDK

SEQ ID NO: 724 - protein, 404 aa, Streptococcus pneumoniae
MKEYNKSSKLEHVAYDIRGPVLEEAMRMRANGEKILRLNTGNPAEFGFTAPDEVIHDLIMNARDSEGYSDSKGIFSARKAIMQYCQLKKFPNVDTDDIYLGNGVSELIVMSMQGLLDNGDEVLVPMPDYPLWTAAVSLAGGNAVHYICDEAVEWYPDIDDIKSKITSNTKAIVLINPNNPTGALYPKELLLEIIEIARQNDLIIFADEIYDRMVMDGHVHTPVASLAPDVFCVSMNGLSKSHRIAGFRVGWMVLSGPKTHVKGYIEGLNMLSNMRLCSNVLAQQVVQTSLGGHQSVDELLLPGGRIYEQRNFIYNAIQDIPGLSAVKPKAGLYIFPKIDRNMYRIDDDEQFVLDFLKQEKVLLVHGRGFNWQEPDHFRIVYLPRVDELAQIQEKMTRFLKQYRR

SEQ ID NO: 725 - protein, 171 aa, Streptococcus pneumoniae
MLYFYSEKVYNYSKKISGGFIMAQRYQNIMVAIDGSKEADLAFVKGVHSALRNDAKLTIAHVIDTRALQSVSTFDAEVYEELQVDAESLMKEYEKRAKDAGVADVHIVIEMGNPKTLLARTIPDAEEVDLILVGATGLNAFERLLVGSSSEYILRHAKVDLLVVREQEKTL

SEQ ID NO: 726 - protein, 346 aa, Streptococcus pneumoniae
MCEIERTGKGMNADDTVTIYDVAREAGVSMATVSRVVNGNKNVKENTRKKVLEVIDRLDYRPNAVARGLASKKTTTVGVVIPNITNGYFSSLAKGIDDIAEMYKYNIVLANSDEDNEKEVSVVNTLFSKQVDGIIYMGYHLTDKIRSEFSRSRTPIVLAGTVDVEHQLPSVNIDYKQATIDAVSYLAKENERIAFVSGPLVDDINGKVRLVGYKETLKKAGITYSEGLVFESKYSYDDGYALAERLISSNATAAVVTGDELAAGVLNGLADKGVSVPEDFEIITSDDSQISRFTRPNLTTIAQPLYDLGAISMRMLTKIMHKEELEEREVLLPHGLTERSSTRKRK

SEQ ID NO: 727 - protein, 183 aa, Streptococcus pneumoniae
MKGNIMDSFDKGWFVLQTYSGYENKVKENLLQRAQTYNMLDNILRVEIPTQTVQVEKNGKRKEVEENRFPGYVLVEMVMTDEAWFVVRNTPNVTGFVGSHGNRSKPTPLLEQEIRDILVSMGQTVQEFDFDVEIGQTVRIIDGAFADYTGKITEIDNNKVKMIISMFGNDTVAEVNLNQIAEL

SEQ ID NO: 728 - protein, 731 aa, Streptococcus pneumoniae
MKLDKLFEKFLSLFKKETSELEDSDSTILRRSRSDRKKLAQVGPIRKFWRRYHLTKIILILGLSAGLLVGIYLFAVAKSTNVNDLQNALKTRTLIFDREEKEAGALSGQKGTYVELTDISKNLQNAVIATEDRSFYKNDGINYGRFFLAIVTAGRSGGGSTITQQLAKNAYLSQDQTVERKAKEFFLALELSKKYSKEQILTMYLNNAYFGNGVWGVEDASKKYFGVSASEVSLDQAATLAGMLKGPELYNPLNSVEDSTNRRDTVLQNMVAAGYIDKNQETKAAEVDMTSQLHDKYEGKISDYRYPSYFDAVVNEAVSKYNLTEEEIVNNGYRIYTELDQNYQANMQIVYENTSLFPRAEDGTFAQSGSVALEPKTGGVRGVVGQVADNDKTGFRNFNYATQSKRSPGSTIKPLVVYTPAVEASWALNKQLDNHTMQYDSYKVDNYAGIKTSREVPMYQALAESLNLPAVATVNDLGVDKAFEAGEKFGLNMEKVDRVLGVALGSGVETNPLQMAQAYAAFANEGLMPEAHFISRIENASGQVIASHKNSQKRVIDKSVADKMTSMMLGTFTNGTGISSSPADYVMAGKTGTTEAVFNPEYTSDQWVIGYTPDVVISHWLGFPTTDENHYLAGSTSNGAAHVFRNIANTILPYTPGSTFTVENAYKQNGIAPANTKRQVQTNDNSQTDDNLSDIRGRAQSLVDEASRAISDAKIKEKAQTIWDSIVNLFR

SEQ ID NO: 729 - protein, 396 aa, Streptococcus pneumoniae
MTKTIAINAGSSSLKWQLYLMPEEKVLAKGLIERIGLKDSISTVKFDGRSEQQILDIENHIQAVKILLDDLIRFDIIKAYDEITGVGHRVVAGGEYFKESTVVEGDVLEKVEELSLLAPLHNPANAAGVRAFKELLPDITSVVVFDTSFHTSMPEKAYRYPLPTKYYTENKVRKYGAHGTSHQFVAGEAAKLLGRPLEDLKLITCHIGNGGSITAVKAGKSVDTSMGFTPLGGIMMGTRTGDIDPAIIPYLMQYTEDFNTPEDISRVLNRESGLLGVSANSSDMRDIEAAVAEGNHEASLAYEMYVDRIQKHIGQYLAVLNGADAIVFTAGVGENAESFRRDVISGISWFGCDVDDEKNVFGVTGDISTEAAKIRVLVIPTDEELVIARDVERLKK

SEQ ID NO: 730 - protein, 352 aa, Streptococcus pneumoniae
MKAYTYVKPGLASFVDVDKPVIRKPTDAIVRIVKTTICGTDLHIIKGDVPTCQSGTILGHEGIGIVEEVGEGVSNFKKGDKVLISCVCACGKCYYCKKGIYAHCEDEGGWIFGHLIDGMQAEYLRVPHADNTLYHTPEDLSDEALVMLSDILPTGYEIGVLKGKVEPGCSVAIIGSGPVGLAALLTAQFYSPAKLIMVDLDDNRLETALSFGATHKVNSSDPEKAIKEIYDLTDGRGVDVAIEAVGIPATFDFCQKIIGVDGTVANCGVHGKPVEFDLDKLWIRNINVTTGLVSTNTTPQLLKALESHKIEPEKLVTHYFKLSEIEKAYEVFSKAADHHAIKVIIENDISEA

SEQ ID NO: 731 - protein, 564 aa, Streptococcus pneumoniae
MLIQKIKTYKWQALASLLMTGLMVASSLLQPRYLQEVLGALLTGKYEAIYSIGAWLIGVAVVGLVAGGLNVVLAAYIAQGVSSDLREDAFRKIQTFSYADIEQFNAGNLVVRMTNDINQIQNVVMMTFQILFRLPLLFIGSFILAVQTLPSLWWVIVLMVVLIFGLTAVMMGMMGPRFAKFQTLLERINAIAKENLRGVRVVKSFVQEKEQFAKFTEVSDELLGQNLYIGYAFSVVEPFMMLVGYGAVFLSIWLVAGMVQSDPSVVGSIASFVNYLSQIIFTIVMVGFLGNSVSRAMISMRRIREILDAEPAMTFKDIPDEELVGSLSFENVTFTYPMDKEPMLKDVSFTIEPGQMVGVVGATGAGKSTLAQLIPRLFDPQDGAIKIGGKDIREVSEGTLRKTVSIVLQRAILFSGTIADNLRQGKGNATLFEMERAANIAQASEFIHRMEKTFESPVEERGTNFSGGQKQRMSIARGIVSNPRILIFDDSTSALDAKSERLVQEALNKDLKGTTTIIIAQKISSVVHADKILVLNQGRLIGQGTHADLVANNAVYREIYETQK

SEQ ID NO: 732 - protein, 338 aa, Streptococcus pneumoniae
MEKQTVAVLGPGSWGTALSQVLNDNGHEVRIWGNLPEQINEINTHHTNKHYFKDVVLDENIIAYTDLAETLKDVDAILFVVPTKVTRLVAQQVAQTLDHKVIIMHASKGLEPDSHKRLSTILEEEIPEHLRSDIVVVSGPSHAEETIVRDLTLITAASKDLQTAQYVQKLFSNHYFRLYTNTDVIGVETAGALKNIIAVGAGALHGLGFGDNAKAAIIARGLAEITRLGVALGASPLTYSGLSGVGDLIVTGTSIHSRNWRAGDALGRGESLADIEANMGMVIEGISTTRAAYELAQELGVYMPITQAIYQVIYHGTNIKDAIYDIMNNEFKAENEWS

SEQ ID NO: 733 - protein, 423 aa, Streptococcus pneumoniae
MSSKFMKSAAVLGTATLASLLLVACGSKTADKPADSGSSEVKELTVYVDEGYKSYIEEVAKAYEKEAGVKVTLKTGDALGGLDKLSLDNQSGNVPDVMMAPYDRVGSLGSDGQLSEVKLSDGAKTDDTTKSLVTAANGKVYGAPAVIESLVMYYNKDLVKDAPKTFADLENLAKDSKYAFAGEDGKTTAFLADWTNFYYTYGLLAGNGAYVFGQNGKDAKDIGLANDGSIVGINYAKSWYEKWPKGMQDTEGAGNLIQTQFQEGKTAAIIDGPWKAQAFKDAKVNYGVATIPTLPNGKEYAAFGGGKAWVIPQAVKNLEASQKFVDFLVATEQQKVLYDKTNEIPANTEARSYAEGKNDELTTAVIKQFKNTQPLPNISQMSAVWDPAKNMLFDAVSGQKDAKTAANDAVTLIKETIKQKFGE

SEQ ID NO: 734 - protein, 335 aa, Streptococcus pneumoniae
MTEKLINSKPNGVFALILIELTIVLGIFIFIMGVGSENIFGIIIGPLLIVIAGLAHAGLKVVKPQEALVLTLFGNYTGTIKEPGFYFVNPFSVAVNPANHTRLGQSGDVSTKSPFLGAKSSNDNDVNLEIGKKQISLKVMTLSNSRQKINDCLGNPVEIGIAVTWRVVDTAKAVFNVDNYKEYLSLQCDSALRNIVRIYPYDVSPNVDTTGDGQADEGSLRGSSEIVANRIREEIQSRVEDAGLEILEARITYLAYAPEIAAVMLQRQQASAIIDARKMIVDGAVGMVEMALERLNEGELVELDEERKAAMVSNLLVVLCGNHDAQPIVNTGSLY

SEQ ID NO: 735 - protein, 338 aa, Streptococcus pneumoniae
MTNSVFQGRSFLAEKDFTRAELEYLIGLSAHLKDLKKRNIQHHYLAGKNIALLFEKTSTRTRAAFTTAAIDLGAHPEYLGANDIQLGKKESTEDTAKVLGRMFDGIEFRGFSQRMVEELAEFSGVPVWNGLTDEWHPTQMLADYLTVQENFGRLEGLTLVYCGDGRNNVANSLLVTGAILGVNVHIFSPKELFPEKEIVELAEGFAKESGAHVLITEDADEAVKDADVLYTDVWVSMGEEDKFAERVALLKPYQVNMDLVKKAGNENLIFLHCLPAFHDTHTVYGKDVAEKFGVEEMEVTDEVFRSKYARHFDQAENRMHTIKAVMAATLGNLYIPKV

SEQ ID NO: 736 - protein, 299 aa, Streptococcus pneumoniae
MAIFFMIFLIVCVLLLVIVTLSTVYVVRQQSVAIIERFGKYQKVANSGIHIRLPFGIDSIAARIQLRLLQSDIVVETKTKDNVFVMMNVATQYRVNEQSVTDAYYKLIRPESQIKSYIEDALRSSVPKLTLDELFEKKDEIALEVQHQVAEEMTTYGYIIVKTLITKVEPDAEVKQSMNEINAAQRKRVAAQELAEADKIKIVTAAEAEAEKDRLHGVGIAQQRKAIVDGLAESITELKEANVGMTEEQIMSILLTNQYLDTLNTFASKGNQTIFLPNTPNGVDDIRTQILSALRAEKK

SEQ ID NO: 737 - protein, 173 aa, Streptococcus pneumoniae
MRKFRYNSQTRSRFKERGGFVMRFKNTSDHIEAYIKAILDQSGIVELQRSQLADTFQVVPSQINYVIKTRFTESRGYLVESKRGGGGYIRIGRIEFSSHHEMLRELLYSIGERVSQEIYEDILQLLVEQELMTKQEMNLLESVALDRVLGEEAPVVRANMLRQIIQEVDRKGK

SEQ ID NO: 738 - protein, 150 aa, Streptococcus pneumoniae
MKVIFLADVKGKGKKGEIKEVPTGYAQNFLIKKNLAKEATAQAVGELRGKQKSEEKAHAEMIAEGKAIKAQLEAEETVVEFVEKVGPDGRTFGSITNKKIAEELQKQFGIKIDKRHIQVQAPIRAVGLIDVPVKIYQDITSVINLRVKEG

SEQ ID NO: 739 - protein, 182 aa, Streptococcus pneumoniae
MIKYSIRGENLEVTEAIRDYVVSKLEKIEKYFQPEQELDARINLKVYREKTAKVEVTIPLGSITLRAEDVSQDMYGSIDLVTDKIERQIRKNKTKIERKNKNKVATGQLFTDALVEDSNIVQSKVVRSKQIDLKPMDLEEAILQMDLLGHDFFIYVDVEDQTTNVIYRREDGEIGLLEVKES

SEQ ID NO: 740 - protein, 346 aa, Streptococcus pneumoniae
MAEITAKLVKELREKSGAGVMDAKKALVETDGDIEKAIELLREKGMAKAAKKADRVAAEGLTGVYVNGNVAAVIEVNAETDFVAKNAQFVELVNTTAKVIAEGKPANNEEALALIMPSGETLEAAYVSATATIGEKISFRRFALIEKTDAQHFGAYQHNGGRIGVISVVEGGDEALAKQLSMHIAAMKPTVLSYKELDEQFVKDELAQLNHVIDQDNESRAMVNKPALPHLKYGSKAQLTDDVIAQAEADIKAELAAEGKPEKIWDKIIPGKMDRFMLDNTKVDQAYTLLAQVYIMDDSKTVEAYLESVNASVVEFARFEVGEGIEKAANDFEAEVAATMAAALNN

SEQ ID NO: 741 - protein, 286 aa, Streptococcus pneumoniae
MNCEAVALGSFCELKSRRGKKQKGEILMAVISMKQLLEAGVHFGHQTRRWNPKMAKYIFTERNGIHVIDLQQTVKYADQAYDFMRDAAANDAVVLFVGTKKQAADAVAEEAVRSGQYFINHRWLGGTLTNWGTIQKRIARLKEIKRMEEDGTFEVLPKKEVALLNKQRARLEKFLGGIEDMPRIPDVMYVVDPHKEQIAVKEAKKLGIPVVAMVDTNTDPDDIDVIIPANDDAIRAVKLITAKLADAIIEGRQGEDAVAVEAEFAALETQADSIEEIVEVVEGDNA

SEQ ID NO: 742 - protein, 272 aa, Streptococcus pneumoniae
MNRFKKSKYVIIVFVTVLLVSALLATTYSSTIVTKLGDGISLVDRVVQKPFQWFDSVKSDLAHLTRTYNENESLKKQLYQLEVKSNEVESLKTENEQLRQLLDMKSKLQATKTLAADVIMRSPVSWKQELTLDAGRSKGASENMLAIANGGLIGSVSKVEENSTIVNLLTNTENADKISVKIQHGSTTIYGIIIGYDKENDVLKISQLNSNSDISAGDKVTTGGLGNFNVADIPVGEVVATTHSTDYLTREVTVKLSADTHNVDVIELVGNS

SEQ ID NO: 743 - protein, 275 aa, Streptococcus pneumoniae
MKSIIDVKNLSFRYKENQNYYDVKDITFHVKRGEWLSIVGHNGSGKSTTVRLIDGLLEAESGEIVIDGQRLTEENVWNIRRQIGMVFQNPDNQFVGATVEDDVAFGLENQGLSRQEMKKRVEEALALVGMLDFKKREPARLSGGQKQRVAIAGVVALRPAILILDEATSMLDPEGRRELIGTVKGIRKDYDMTVISITHDLEEVAMSDRVLVMKKGEIESTSSPRELFSRNDLDQIGLDDPFANQLKKSLSQNGYDLPENYLTESELEDKLWELL

SEQ ID NO: 744 - protein, 276 aa, Streptococcus pneumoniae
MTSMRKKTIGEVLRLARINQGLSLDELQKKTEIQLDMLEAMEADDFDQLPSPFYTRSFLKKYAWAVELDDQIVLDAYDSGSMITYEEVDVDEDELTGRRRSSKKKKKKTSFLPLFYFILFALSILIFVTYYVWNYIQTQPEEPSLSNYSVVQSTSSTSSVPHSSSSSSSSIESAISVSGEGNHVEIAYKTSKETVKLQLAVSDVTSWVSVSESELEGGVTLSPKKKSAEATVATKSPVTITLGVVKGVDLTVDNQTVDLSKLTAQTGQITVTFTKN

SEQ ID NO: 745 - protein, 339 aa, Streptococcus pneumoniae
MENLVKSTSYTYIPEEIMSFSDLKLFALSSNKELAERVAQEIGIELGKSSVRQFSDGEIQVNIEESIRGKHVFILQSTSSPVNDNLLEILIMVDALKRASAESVNVVMPYYGYARQDRKARAREPITSKLVANMLEVAGVDRLLTIDLHAAQIQGFFDIPVDHLMGAPLIADYFERRGMVGSDYVVVSPDHGGVTRARKLAEFLKTSIAIIDKRRSVDKMNTSEVMNIIGKVEGKTCILIDDMIDTAGTICHAADALAEAGAVEVYASCTHPVLSGPATDNIQKSAIKKLVVLDTIYLPEERLIDKIEQISIAHLLGDAIVRIHEKRPLSPLFDIEKKI

SEQ ID NO: 746 - protein, 220 aa, Streptococcus pneumoniae
MDLTKRFNKQLDKIQVSLIRQFDQAISEIPGVLRLTLGEPDFTTPDHVKEAGKRAIDQNQSYYTGMSGLLTLRQAASDFVKEKYQLDYAPENEILVTIGATEALSATLTAILEEGDKVLLPAPAYPGYEPIVNLVGAEIVEIDTTENGFVLTPEMLEKAILEQGDKLKAVILNYPANPTGITYSREQLEALAAVLRKYEIFVVCDEVYSELTYTGEAMCL

SEQ ID NO: 747 - protein, 432 aa, Streptococcus pneumoniae
MINRYSRPEMANIWSEENKYRAWLEVEILSDEAWAELGEIPKEDVALIRKKADFDIDRILEIEQETRHDVVAFTRAVSETLGEERKWVHYGLTSTDVVDTAYGYLYKQANDIIRRDLENFTNIIADKAKEHKFTIMMGRTHGVHAEPTTFGLKLATWYSEMKRNIERFEHAAAGVEAGKISGAVGNFANIPPFVEEYVCDKLGIRAQEISTQVLPRDLHAEYFAVLASIATSIERMATEIRGLQKSEQREVEEFFAKGQKGSSAMPHKRNPIGSENMTGLARVIRGHMITAYENVALWHERDISHSSAERIITPDTTILIDYMLNRFGNIVKNLTVFPENMIRNMNSTFGLIFSQRAMLTLIEKGMTREQAYDLVQPKTAYSWDNQVDFKPLLEADSEVTSRLTQEEIDEIFNPVYYTKRVDDIFERLGLGD

SEQ ID NO: 748 - protein, 301 aa, Streptococcus pneumoniae
MIQWWQILLLTLYSAYQICDELTIVSSAGSPVFAGFITGLIMGDVTTGLLIGGNLQLFVLGVGTFGGASRIDATSGAVLATAFSVSQGIDAPLAITTIAVPVAALLTYFDVLGRMTTTFFAHRVDAAIERFDYKGIERNYLLGAIPWALSRALPVFFALAFGGAFVQSVVDFVEAYKWVADGLTLAGRMLPGLGFAILLRYLPVKRNLHYLAMGFGLTAMLTVLYSYVTGLGGAVAGIVGTLPAEVAEKIGFVNNFKGLSMIGISIVGIFLAVLHFKNSQKVAVAAPSTPSESGEIEDDEF

SEQ ID NO: 749 - protein, 276 aa, Streptococcus pneumoniae
MGKSKMTNSNYKLTKEDFNQINKRSLFTFQLGWNYERMQASGYLYMILPQLRKMYGDGTPELKEMMKVHTQFFNTSPFFHTIIAGFDLAMEEKDGVGSKDAVNGIKTGLMGPFAPLGDTIFGSLVPAIMGSVAATMAIAGQPWGIFLWIAVAVAYDIFRWKQLEFAYKEGVNLINNMQSTLTALIDAASVLGVFMMGALVATVINFEISYKLPIGEKMIDFQDILNQIFPRLLPAIFTAFIFWLLGKKGMNSTKAIGIIIVLALALSALGHFALGM

SEQ ID NO: 750 - protein, 388 aa, Streptococcus pneumoniae
MLHYTKEDLLELGAEITTREIYQQPDVWREAFEFYQAKREEIAAFLQEIADKHDYIKVILTGAGTSAYVGDTLLPYFKEVYDERKWNFNAIATTDIVANPATYLKKDVATVLVSFARSGNSPESLATVDLAKSLVDELYQVTITCAADGKLALQAHGDDRNLLLLQPAVSNDAGFAMTSSFTSMMLTTLLVFDPTEFAVKSERFEVVSSLARKVLDKAEDVKELVDLDFNRVIYLGAGPFFGLAHEAQLKILELTAGQVATMYESPVGFRHGPKSLINDNTVVLVFGTTTDYTRKYDLDLVREVAGDQIARRVVLLSDQAFGLENVKEVALGCGGVLNDIYRVFPYIVYAQLFALLTSLKVENKPDTPSPTGTVNRVVQGVIIHEYQK

SEQ ID NO: 751 - protein, 203 aa, Streptococcus pneumoniae
MSRYTGPSWKQARRLGLSLTGTGKELARRNYVPGQHGPNNRSKLSEYGLQLAEKQKLRFTYGVGEKQFRNLFVQATKIKGGILGFNFMLLLERRLDNVVYRLGLATTRRQARQFVNHGHILVDGKRVDIPSYRVTPGQVISVREKSLKVPAILEAVEATLGRPAFVSFDAEKLEGSLTRLPERDEINPEINEALVVEFYNKML

SEQ ID NO: 752 - protein, 328 aa, Streptococcus pneumoniae
MAKDIRVLLYYLYTPIENAEQFAADHLAFCKSIGLKGRILVADEGINGTVSGDYETTQKYMDYVHSLPGMEELWFKIDEENEQAFKKMFVRYKKEIVHLGLEDNDFDNDINPLETTGAYLSPKEFKEALLDKDTVVLDTRNDYEYDLGHFRGAIRPDIRNFRELPQWVRDNKEKFMDKRVVVYCTGGVRCEKFSGWMVREGYKDVGQLHGGIATYGKDPEVQGELWDGKMYVFDERIAVDVNHVNPTIVGKDWFDGTPCERYVNCGNPFCNRRILTSEENEDKYLRGCSHECRVHPRNRYVSKNELTQAEVIERLAAIGESLDQAATV

What is claimed is:

1. An isolated *Streptococcus pneumoniae* polynucleotide comprising at least 95% identity to the full length nucleotide sequence of SEQ ID NO:91, and wherein the polynucleotide encodes an immunogenic polypeptide.

2. An isolated polynucleotide, wherein the polynucleotide is a complement to the nucleotide sequence of SEQ ID NO:91.

3. The polynucleotide of claim 1 wherein the polynucleotide is selected from the group consisting of DNA, chromosomal DNA, cDNA and RNA.

4. The polynucleotide of claim 1 wherein the polynucleotide further comprises heterologous nucleotides.

5. An isolated polynucleotide which hybridizes to the full length nucleotide sequence of SEQ ID NO:91, or a complement thereof, under high stringency hybridization conditions, wherein the high stringency hybridization is at 65° C. with lxSSC followed by a 65° C. wash with O.3×SSC, and wherein the polynucleotide encodes an immunogenic polypeptide.

6. An isolated *Streptococcus pneumoniae* polynucleotide, wherein the polynucleotide comprises the nucleotide sequence of SEQ ID NO:91, and encodes a polypeptide, selected from the group consisting of:
 (a) a *Streptococcus pneumoniae* polypeptide having 0, 1 or 2 transmembrane domains;
 (b) a *Streptococcus pneumoniae* polypeptide having 3 or more transmembrane domains;
 (c) a *Streptococcus pneumoniae* polypeptide having an outer membrane domain or
 a periplasmic domain;
 (d) a *Streptococcus pneumoniae* polypeptide having an inner membrane domain;
 (e) a *Streptococcus pneumoniae* polypeptide identified by Blastp analysis;
 (f) a *Streptococcus pneumoniae* polypeptide identified by Pfam analysis;
 (g) a *Streptococcus pneumoniae* lipoprotein;
 (h) a *Streptococcus pneumoniae* polypeptide having a LPXTG motif, wherein the polypeptide is covalently attached to the peptidoglycan layer;
 (i) a *Streptococcus pneumoniae* polypeptide having a peptidoglycan binding motif, wherein the polypeptide is associated with the peptidoglycan layer;
 (j) a *Streptococcus pneumoniae* polypeptide having a signal sequence and a C-terminal Tyrosine or a C-terminal Phenylalanine amino acid;
 (k) a *Streptococcus pneumoniae* polypeptide having a tripeptide RGD amino acid sequence;
 (l) a *Streptococcus pneumoniae* polypeptide identified by proteomics as surface exposed; and
 (m) a *Streptococcus pneumoniae* polypeptide identified by proteomics as membrane associated.

7. The polynucleotide of claim 6, wherein the polynucleotide is a complement to the nucleotide sequence of SEQ ID NO:91.

8. The polynucleotide of claim 7, wherein the polynucleotide is selected from the group consisting of DNA, chromosomal DNA, cDNA and RNA.

9. The polynucleotide of claim 8, wherein the polynucleotide further comprises heterologous nucleotides.

10. The polynucleotide of claim 9, wherein the polynucleotide encodes a fusion polypeptide.

11. The polynucleotide of claim 6, wherein the polynucleotide of SEQ ID NO:91 encodes a polypeptide having 0, 1 or 2 transmembrane domains.

12. The polynucleotide of claim 6, wherein the polynucleotide of SEQ ID NO:91 encodes a polypeptide having an inner membrane domain.

13. The polynucleotide of claim 6, wherein the polynucleotide of SEQ ID NO:91 encodes a polypeptide identified by proteomics as surface exposed.

14. An isolated recombinant expression vector comprising a polynucleotide having at least 95% identity to the full length nucleotide sequence of SEQ ID NO:91, wherein the polynucleotide encodes for an immunogenic polypeptide.

15. The vector of claim 14, wherein the polynucleotide is selected from the group consisting of DNA, chromosomal DNA, cDNA, RNA and antisense RNA.

16. The vector of claim 15, wherein the polynucleotide further comprises heterologous nucleotide sequences.

17. The vector of claim 16, wherein the polynucleotide is operatively linked to one or more gene expression regulatory elements.

18. The vector of claim 17, wherein the polynucleotide encodes a polypeptide comprising an amino acid sequence having at least 95% identity to the amino acid sequence of SEQ ID NO:306.

19. The vector of claim 14, wherein the vector is a plasmid.

20. An isolated genetically engineered host cell, transfected, transformed or infected with the vector of claim 14.

21. The host cell of claim 20, wherein the host cell is a bacterial cell.

22. The host cell of claim 21, wherein the polynucleotide is expressed to produce the encoded polypeptide.

23. An isolated polynucleotide of a *Streptococcus pneumoniae*, wherein the polynucleotide encodes a polypeptide comprising the amino acid sequence of SEQ ID NO:306.

24. An isolated polynucleotide comprising the nucleotide sequence of SEQ ID NO: 91.

25. An isolated polynucleotide that encodes a polypeptide comprising the amino acid sequence of SEQ ID NO: 306.

26. An isolated polynucleotide that encodes a polypeptide comprising an amino acid sequence having at least 95% identity to the amino acid sequence of SEQ ID NO: 306, wherein the polypeptide is an immunogenic polypeptide.

27. A method for producing a polypeptide which comprises culturing the genetically engineered host cell of claim 21 under conditions suitable to produce the polypeptide and recovering the polypeptide from the culture.

28. A kit comprising a container containing an isolated polynucleotide of claim 1.

29. The kit of claim 28, wherein the polynucleotide is a primer or a probe.

30. The kit of claim 29, wherein the polynucleotide is a primer and the kit further comprises a container containing a polymerase.

31. The kit of claim 28, wherein the kit further comprises a container containing dNTP.

32. An immunogenic composition comprising a polynucleotide having a nucleotide sequence of SEQ ID NO:91 and is comprised in an expression vector.

33. The immunogenic composition of claim 32, wherein the vector is plasmid DNA.

34. The immunogenic composition of claim 33, wherein the polynucleotide further comprises heterologous nucleotides.

35. The immunogenic composition of claim 34, wherein the polynucleotide is operatively linked to one or more gene expression regulatory elements.

36. The immunogenic composition of claim 35, wherein the polynucleotide encodes a polypeptide comprising the amino acid sequence of SEQ ID NO:306.

37. The immunogenic composition of claim 36, further comprising one or more adjuvants.

* * * * *

UNITED STATES PATENT AND TRADEMARK OFFICE
CERTIFICATE OF CORRECTION

| | | |
|---|---|---|
| PATENT NO. | : 7,384,775 B2 | Page 1 of 1 |
| APPLICATION NO. | : 10/474776 | |
| DATED | : June 10, 2008 | |
| INVENTOR(S) | : Robert John Zagursky et al. | |

It is certified that error appears in the above-identified patent and that said Letters Patent is hereby corrected as shown below:

Title Page;

item (73) Assignee:   replace Wyeth with Wyeth Holdings Corporation.

Signed and Sealed this

Third Day of August, 2010

David J. Kappos
*Director of the United States Patent and Trademark Office*